US009357785B2

(12) United States Patent
Gonzalez et al.

(10) Patent No.: US 9,357,785 B2
(45) Date of Patent: *Jun. 7, 2016

(54) METHOD FOR TREATMENT AND CONTROL OF PLANT DISEASE

(71) Applicant: The Texas A&M University System, College Station, TX (US)

(72) Inventors: Carlos F. Gonzalez, College Station, TX (US); Stephen J. Ahern, College Station, TX (US); Mayukh Das, College Station, TX (US); Ryland F. Young, III, College Station, TX (US); Tushar Surva Bhowmick, College Station, TX (US)

(73) Assignee: The Texas A&M University System, College Station, TX (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/057,851

(22) Filed: Oct. 18, 2013

(65) Prior Publication Data

US 2014/0140961 A1 May 22, 2014

Related U.S. Application Data

(60) Provisional application No. 61/716,245, filed on Oct. 19, 2012, provisional application No. 61/785,535, filed on Mar. 14, 2013.

(51) Int. Cl.

| | |
|---|---|
| ***A01N 63/00*** | (2006.01) |
| ***C12R 1/91*** | (2006.01) |
| ***C12N 7/00*** | (2006.01) |

(52) U.S. Cl.

CPC *A01N 63/00* (2013.01); *C12N 7/00* (2013.01); *C12R 1/91* (2013.01); *C12N 2795/10221* (2013.01); *C12N 2795/10231* (2013.01); *C12N 2795/10233* (2013.01); *C12N 2795/10251* (2013.01); *C12N 2795/10321* (2013.01); *C12N 2795/10331* (2013.01)

(58) Field of Classification Search

CPC ............ A01N 63/00; C12R 1/91; C12N 7/00; C12N 2795/10331; C12N 2795/10231; C12N 2795/10321; C12N 2795/10221; C12N 2795/10251; C12N 2795/10233

See application file for complete search history.

(56) References Cited

U.S. PATENT DOCUMENTS

| | | | | |
|---|---|---|---|---|
| 2009/0036307 | A1 | 2/2009 | Gabriel et al. | |
| 2009/0246336 | A1* | 10/2009 | Burnett et al. | 426/326 |
| 2011/0294668 | A1* | 12/2011 | Melander et al. | 504/358 |
| 2012/0020940 | A1 | 1/2012 | Durner et al. | |
| 2012/0177608 | A1 | 7/2012 | Ross et al. | |
| 2015/0257392 | A1 | 9/2015 | Gonzalez et al. | |

FOREIGN PATENT DOCUMENTS

| | | |
|---|---|---|
| WO | WO 90/13631 | 11/1990 |
| WO | WO 2008/062310 | 5/2009 |

OTHER PUBLICATIONS

Wells et al., *Xylella fastidiosa* gen. nov. , sp. nov: Gram-Negative, Xylem-Limited, Fastidious Plant Bacteria Related to *xanthomonas* spp., International Journal of Systematic Bacteriology, Apr. 1987, p. 136-143.*

Ahern et al., “Characterization of novel virulent broad-host-range phages of Xylella fastidiosa and Xanthomonas,” *J. Bacteriology* 196(2):459-471, 2013.

Balogh et al., “Control of citrus canker and citrus bacterial spot with bacteriophages,” *Plant Disease* 92:1048-1052, 2008.

Bextine et al., “Laboratory-based monitoring of an insect transmitted plant pathogen system,” *Biotechniques* 38:184, 186, 2005.

Bextine et al., “*Xylella fastidiosa* genotype differentiation by SYBR® Green-based QRT-PCR,” *FEMS Microbiology Letters* 276:48-54, 2007.

Brunings et al., “*Xanthomonas citri*: breaking the surface,” *Mol. Plant. Pathol*. 4:141-57, 2003.

Casjens et al., “Diversity among the tailed-bacteriophages that infect the Enterobacteriaceae,” *Research in Microbiology* 159:340-348, 2008.

Casjens et al., “Determining DNA packaging strategy by analysis of the Termini of the chromosomes in Tailed-bacteriophage virions,” *Methods Mol. Biol*. 502:91-111, 2009.

Cursino et al., “Twitching motility and biofilm formation are associated with tonB1 in *Xylella fastidiosa,” FEMS Microbiology Letters* 299:193-199, 2009.

Dunn et al., “Complete nucleotide sequence of bacteriophage T7 DNA and the locations of T7 genetic elements,” *J. Mol. Biol*. 166:477-535, 1983.

Gill et al., “Genomes and Characterization of Phages Bcep22 and BcepIL02, Founders of a Novel Phage Type in *Burkholderia cenocepacia,” J. Bacteriol*. 193:5300-5313, 2011.

Hendson et al., “Genetic diversity for Pierce’s disease strains and other pathotypes of *Xylella fastidiosa,” Applied and Environmental Microbiology* 67(2):895-903, 2001.

Hernandez-Martinez et al., “Differentiation of strains of *Xylella fastidiosa* infecting grape, almonds and oleander using a multiprimer PCR Assay,” *Plant Disease* 90(11):1382-1388, 2006.

Hernandez-Martinez et al., “Phylogenetic Relationships of *Xylella fastidiosa* Strains Isolated from Landscape Ornamentals in Southern California,” *American Phytopathological Society* 97(7):857-864, 2007.

Hill et al., “Multiplication and movement of *Xylella fastidiosa* within grapevine and four other plants,” *Phytopathology* 85(12):1368-1372, 1995.

(Continued)

*Primary Examiner* — Taeyoon Kim
*Assistant Examiner* — Srikanth Patury
(74) *Attorney, Agent, or Firm* — Dentons US LLP

(57) ABSTRACT

The present invention provides methods for development of a virulent bacteriophage-based treatment for the control of plant diseases caused by *Xylella fastidiosa*. The invention further provides methods of isolating and propagating bacteriophage virulent to *X. fastidiosa* in a *Xanthomonas* bacterial host and for treating or reducing symptoms of *X. fastidiosa* infection in a plant. The invention further provides methods of isolating and propagating bacteriophage virulent to *Xanthomonas axonopodis* pv. *citri* and for treating or reducing symptoms of *Xanthomonas axonopodis* pv. *citri* infection in a plant.

13 Claims, 12 Drawing Sheets

(56) References Cited

OTHER PUBLICATIONS

Hopkins et al., "Biological control of Pierce's disease in the vineyard with strains of *Xylella fastidiosa* benign to grapevine," *Plant Dis.* 89:1348-1352, 2005.

Jones et al., "Bacteriophages for plant disease control," *Ann. Rev Phytopathol.* 45:245-262, 2007.

Kasman et al., "Overcoming the phage replication threshold: a mathematical model with implications for phage therapy," *J. Virol.* 76(11):5557-5564, 2002.

Lavigne et al., "The genome of bacteriophage phiKMV, a T7-like virus infecting *Pseudomonas aeruginosa,*" *Virology* 312:49-59, 2003.

Li et al., "Type I and type IV pili of *Xylella fastidiosa* affect twitching motility, biofilm formation and cell-cell aggregation," *Microbiology* 153:719-726, 2007.

Li et al., "Genome-wide mutagenesis of *Xanthomonas axonopodis* pv. *citri* reveals novel genetic determinants and regulation mechanisms of biofilm formation," *PLoS One* 6:e21804, 2011.

Nocker, "Comparison of propidium monoazide with ethidium monoazide for differentiation of live vs. dead bacteria by selective removal of DNA from dead cells," *J Microbiol Meth.* 67(2):310-20, 2006.

Nunney et al., "Population Genomic Analysis of a Bacterial Plant Pathogen: Novel Insight into the Origin of Pierce's Disease of Grapevine in the U.S.," *PLoS One* 5(11):e15488, 2010.

Roine et al., "Characterization of Type IV Pilus Genes in *Pseudomonas syringae* pv. *tomato* DC3000," *Mol. Plant Microbe Interact.* 11:1048-1056, 1998.

Sherald et al., "Sycamore leaf scorch: culture and pathogenicity of fastidious xylem-limited bacteria from scorch-affected trees," *Plant Disease* 67:849-852, 1983.

Summer et al., "Preparation of a phage DNA fragment library for whole genome shotgun sequencing." In: Clokie, M. and Kropinski, A. (eds.), *Bacteriophages: Methods and Protocols,* vol. 2*: Molecular and Applied Aspects* (Humana Press), pp. 27-46, 2009.

Summer et al., "Genomic and biological analysis of phage Xfas53 and related prophages of *Xylella fastidiosa,*" *J. Bacteriol.* 192:179-190, 2010.

Whitehorn et al., "Neonicotinoid pesticide reduces bumble bee colony growth and queen production," *Science* 336:351-352, 2012.

Yang et al., "PilR enhances the sensitivity of *Xanthomonas axonopodis* pv. *citri* to the infection of filamentous bacteriophage Cf.," *Curr. Microbiol.* 48:251-61, 2004.

USPTO, Notification of Transmittal of the International Search Report and Written Opinion of the International Searching Authority for PCT/US2013/065710, dated Apr. 16, 2014.

U.S. Appl. No. 14/433,852, filed Apr. 6, 2015, Gonzalez et al.

* cited by examiner

Fig. 1
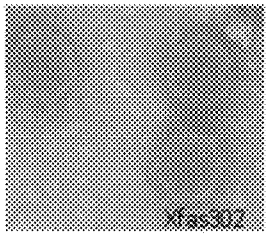
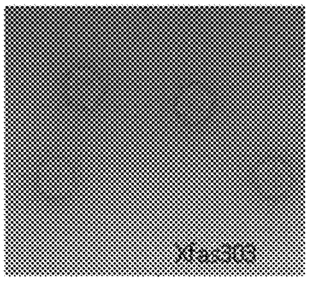
| Phage | Head Size (nm) |
|---|---|
| Xfas302 | 60 |
| Xfas303 | 65 |
| Xfas305 | 58 |
| Xfas304 | 65 |
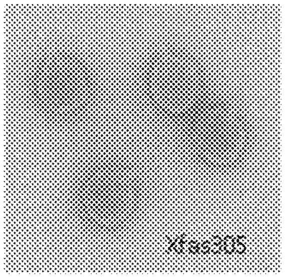
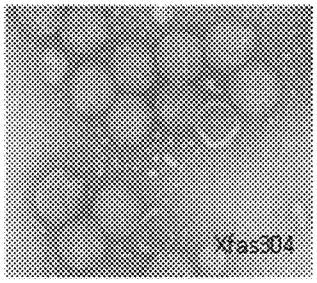

Fig. 2
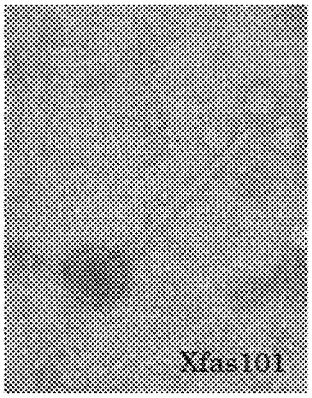
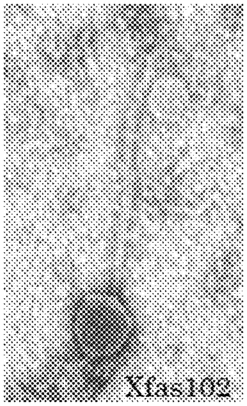
| Phage | Head Size (nm) | Tail Size (nm) |
|---|---|---|
| Xfas101 | 63.4 | 262 |
| Xfas102 | 55 | 200 |
| Xfas103 | 64 | 210 |
| Xfas104 | 64 | 230 |
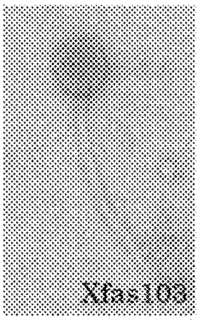
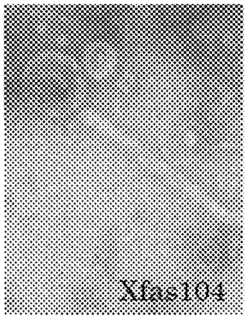

Siphoviridae

Fig. 7

| Observation for PD symptoms§ | VinesInoculated with XF, Phage or Buffer | | | | Inoculated with XF & Challenged with Phage | | Inoculated with Phage & Challenged with XF-15 |
|---|---|---|---|---|---|---|---|
| | XF-15 (15)* | XF-54 (15)* | Phage Xfas304** (24)* | Buffer (6)* | XF-15 (15)* | XF-54 (15)* | (6)* |
| Wk. 0 (10/05/11) | 0*** | 0 | 0 | 0 | 0 | 0 | 0 |
| Wk. 1 (10/12/11) | 0 | 0 | 0 | 0 | 0 | 0 | 0 |
| Wk. 2 (10/19/11) | 0 | 0 | 0 | 0 | 0 | 0 | 0 |
| Wk. 3 (10/26/11) | 1 | 1 | 0 | 0 | 1 | 1 | 0 |
| Wk. 4 (10/31/11) | 2 | 2 | 0 | 0 | 2 | 2 | 0 |
| Wk. 4 (11/04/11) | 3 | 3 | 0 | 0 | 3 | 2 | 0 |
| Wk. 5 (11/07/11) | 5 | 4 | 0 | 0 | 5 | 4 | 0 |
| Wk. 5 (11/11/11) | 7 | 6 | 0 | 0 | 5 | 4 | 0 |
| Wk. 6 (11/14/11) | 9 | 6 | 0 | 0 | 5 | 4 | 0 |
| Wk. 6 (11/18/11) | 9 | 7 | 0 | 0 | 5 | 4 | 0 |
| Wk. 7 (11/21/11) | 10 | 8 | 0 | 0 | 5 | 4 | 0 |
| Wk. 7 (11/25/11) | 10 | 9 | 0 | 0 | 5 | 4 | 0 |
| Wk. 8 (11/28/11) | 11 | 10 | 0 | 0 | 5 | 4 | 0 |
| Wk. 8 (12/02/11) | 11 | 10 | 0 | 0 | 5 | 4 | 0 |
| Wk. 9 (12/05/11) | 11 | 11 | 0 | 0 | 5 | 4 | 0 |
| Wk. 9 (12/09/11) | 12 | 11 | 0 | 0 | 5 | 4 | 0 |
| Wk. 10 (12/12/11) | 12 | 12 | 0 | 0 | 5 | 4 | 0 |
| Wk. 10 (12/16/11) | 12 | 12 | 0 | 0 | 5 | 4 | 0 |
| Wk. 11 (12/19/11) | 12 | 12 | 0 | 0 | 5 | 4 | 0 |
| Wk. 11 (12/23/11) | 12 | 12 | 0 | 0 | 5 | 4 | 0 |
| Wk. 12 (12/26/11) | 12 | 12 | 0 | 0 | 5 | 4 | 0 |
| Wk. 12 (12/30/11) | 12 | 12 | 0 | 0 | 5 | 4 | 0 |

Vines in column 2 and 3 challenged with phage. Vines in column 8 challenged with XF15

* Total No. of vines in each category is within parentheses. Note: 3 vines were harvested at time zero to determine input.

** Phage movement data in vines will be presented separately.

*** Number indicated equals vines exhibiting Pierce's Disease symptoms

§ Data collected on dates indicated in parentheses.

| Phage | *XacA* North40 | *XacA* Block22 | *XacA* Fort Besinger |
|---|---|---|---|
| Xfas 303 | + | + | + |

North 40 Block 22 Fort Besinger

Spot Titration of Phage Xfas303 on *Xac* Strains

METHOD FOR TREATMENT AND CONTROL OF PLANT DISEASE

CROSS REFERENCE TO RELATED APPLICATIONS

This application claims benefit of U.S. provisional applications No. 61/716,245, filed Oct. 19, 2012, and No. 61/785,535, filed Mar. 14, 2013, herein incorporated by reference in their entirety.

STATEMENT REGARDING FEDERALLY SPONSORED RESEARCH

The U.S. government has certain rights in this invention, pursuant to the following: Animal & Plant Health Inspection Service (APHIS) Cooperative Agreement Award for the Texas Pierce's Disease Research & Education Program, Agreement Number 11-8500-0955-CA, with AgriLife Research; and Otsuka Pharmaceutical Co., LTD, Agreement number 406039, with AgriLife Research.

INCORPORATION OF SEQUENCE LISTING

The sequence listing that is contained in the file named "TAMC019US_ST25.txt," which is 907 kilobytes as measured in Microsoft Windows operating system and was created on Oct. 17, 2013, is filed electronically herewith and incorporated herein by reference.

FIELD OF THE INVENTION

The invention relates to the field of plant pathology. More specifically, the invention relates to methods and compositions for isolating bacteriophage and for treatment of plant diseases caused by *Xylella fastidiosa* and *Xanthomonas axonopodis* comprising use of a bacteriophage, a virus of bacteria.

BACKGROUND OF THE INVENTION

Bacteria can cause many diseases in plants, including Pierce's Disease of grapevines, and Citrus Canker of citrus plants. The bacteria infect plant tissues and can cause wilting, poor growth, lesions on fruit, and even plant death. Infection can occur through spreading by wind, rain, contaminated equipment, or vector insects, rapidly spreading to other plants, and resulting in deleterious effects to the plant and massive crop losses. Effective treatment of these diseases requires a method of treating the plant to eliminate the bacteria.

SUMMARY OF THE INVENTION

In one aspect, the present invention provides a method of propagating a virulent bacteriophage (phage) that includes *X. fastidiosa* in its host range, comprising infecting a culture of *Xanthomonas* bacteria with the bacteriophage, allowing the bacteriophage to propagate, and isolating bacteriophage particles from the culture. In another embodiment, the *Xanthomonas* bacteria comprises species strain EC-12. In another embodiment, the bacteriophage infects the cell by binding to a cell surface feature. In another embodiment, the cell surface feature is a Type IV pilus. In another embodiment, the bacteriophage comprises a tailed bacteriophage from the group consisting of a podophage, a siphophage, and a myophage. In other embodiments, the bacteriophage is isolated from the environment, a sewage treatment plant, or effluent, a plant, or a surface thereof or from the surrounding soil. In other embodiments of the present invention, a surrogate host is used to enrich for virulent bacteriophage. In still another embodiment, the bacteriophage is virulent in *Xylella fastidiosa*. In other embodiments, agar overlaying is used for growth of the bacteriophage.

In another aspect, the invention provides a method of obtaining a candidate biocontrol agent for Pierce's Disease comprising contacting *X. fastidiosa* and *Xanthomonas* bacteria with a sample comprising a population of virulent bacteriophage and isolating at least a first bacteriophage from the population capable of lysing said *X. fastidiosa* and *Xanthomonas* bacteria. In one embodiment, the bacteriophage infects a cell by binding to a cell surface feature. In another embodiment, the cell surface feature is a Type IV pilus. In still another embodiment, the cell surface feature is required for pathogenesis/virulence of the bacterial host. Other embodiments include contacting a lawn of at least one of *X. fastidiosa* and *Xanthomonas* with the sample, contacting the *X. fastidiosa* and *Xanthomonas* with the sample simultaneously, and contacting the *X. fastidiosa* and *Xanthomonas* with the sample sequentially. In other embodiments, the bacteriophage is isolated from the environment, a sewage treatment plant, or effluent, a plant, or a surface thereof or from the surrounding soil. In another embodiment, the bacteriophage used is virulent in *Xylella fastidiosa*. The method may further comprise detecting lysed bacterial host cells, or plaque formation, after contacting host bacteria with the virulent bacteriophage. In particular embodiments, the method comprises a plate agar overlay or a plate of the bacterial host cells onto which a sample of bacteriophage have been introduced.

In other embodiments, the bacteriophage is prepared by use of a soft agar overlay containing the *X. fastidiosa* and *Xanthomonas*, and in further embodiments, high-titer phage plate lysates are prepared by harvesting one or more overlay plate(s) comprising a *X. fastidiosa* strain or a *Xanthomonas* strain, such as EC-12, exhibiting confluent lysis, followed by maceration and clarification by centrifugation. After being filter sterilized, the resulting lysates may be stored, for instance at 4° C. Subsequently, high-titer phage lysates are purified, for instance by isopycnic CsCl centrifugation, and extracted phage solution are dialyzed. The resulting CsCl-purified bacteriophage typically displays a titer of about $1\times10^{11}$ PFU/ml.

In some embodiments, a ratio of bacteriophage in plant tissue filtrates (PTFs) is about 1 ml of PTF to 20 ml the surrogate host (actively growing culture of selected host) for 4 days for *X. fastidiosa* strain Temecula or for 4 h for *Xanthomonas* strain EC-12.

Another aspect of the invention provides a method of preventing or reducing symptoms or disease associated with *X. fastidiosa* in a plant, comprising contacting a plant with bacteriophage that includes *X. fastidiosa* in its host range, wherein the symptoms or disease associated with *X. fastidiosa* comprise typical Pierce's Disease (PD) symptoms, wherein the leaves display a yellow or red appearance along margins, with eventual leaf margin necrosis. In one embodiment, the bacteriophage particles may be introduced into the plant. In another embodiment, the plant is selected from the group consisting of a grapevine plant, a citrus plant, almond, coffee, alfalfa, oleander, oak, sweetgum, redbud, elm, peach, apricot, plum, blackberry, mulberry, and *Chitalpa tashkentensis*. In another embodiment, the bacteriophages are introduced into the plant by injection, an insect vector or delivered via the root system by injection. In other embodiments, injection comprises a needle or a needle-free system, a pneumatic air or pressure injection system. In other embodiments, the injection is performed manually, or once, or more than once. In another embodiment, the insect vector is a glassy winged sharpshooter. In another embodiment, the bacteriophage to be introduced into the plant is from 1 to $10^{12}$ PFU/ml (plaque forming units/ml), $10^4$ to $10^{11}$ PFU/ml, and $10^7$ to $10^{10}$ PFU/ml. In another embodiment, the bacteriophage particles are obtained by a method comprising infecting a culture of *Xanthomonas* bacteria with the bacteriophage, allowing the bacteriophage to propagate, and isolating bacteriophage particles from the culture. In another embodiment, the method comprises contacting a population of plants with the bacteriophage particles to prevent or reduce symptoms associated with *X. fastidiosa*. In still another embodiment, the bacteriophage comprises at least one bacteriophage (phage) of a strain selected from the Xfas100 phage type or the Xfas300 phage type, described below.

In another aspect, the invention provides a plant disease biocontrol composition formulated for delivery to a plant, the composition comprising at least one diluent, adjuvant or surfactant, and at least one bacteriophage from the Xfas100 phage type or the Xfas300 phage type, described below. In one embodiment, the composition is further defined as being formulated for introduction to a plant via injection, spraying, misting, or dusting. In another embodiment, the composition is further defined as being formulated for topical administration to a plant.

In another aspect, the invention provides a method of obtaining a candidate biocontrol agent for citrus canker comprising contacting *Xanthomonas axonopodis* pv. *citri* bacteria with a sample comprising a population of virulent bacteriophage and isolating at least a first bacteriophage from the population capable of lysing said *Xanthomonas axonopodis* bacteria. In one embodiment, the bacteriophage infects a cell by binding to a cell surface feature. In another embodiment, the cell surface feature is a type IV pilus. In still another embodiment, the cell surface feature is required for pathogenesis/virulence of the bacterial host. Other embodiments include contacting a lawn of *Xanthomonas* with the sample. In another embodiment, the bacteriophage used is virulent in *Xanthomonas axonopodis.*

Another aspect of the invention provides a method of preventing or reducing symptoms or disease associated with *Xanthomonas axonopodis* in a plant, comprising contacting a plant with bacteriophage that includes *Xanthomonas axonopodis* in its host range. In one embodiment, the bacteriophage particles may be introduced into the plant. In some embodiments, the plant is a citrus plant selected from the group consisting of a *Citrus* spp., a *Fortunella* spp., a *Poncirus* spp., a lime, a lemon, an orange, a grapefruit, a pomelo, and hybrids of trifoliate orange used for rootstocks. In another embodiment, the bacteriophages are introduced into the plant by injection, by an insect vector, or is delivered via the root system by injection. In some embodiments, injection comprises a needle or a needle-free system, a pneumatic air or pressure injection system. In other embodiments, the injection is performed manually, or once, or more than once. In another embodiment, the insect vector is a glassy winged sharpshooter. In another embodiment, the bacteriophage to be introduced into the plant is at a concentration of from 1 to $10^{12}$ PFU/ml (plaque forming units/ml), $10^4$ to $10^{11}$ PFU/ml, and $10^7$ to $10^{10}$ PFU/ml. In another embodiment, the method comprises contacting a population of plants with the bacteriophage particles to prevent or reduce symptoms associated with *Xanthomonas axonopodis* and pathovars thereof in the population. In still another embodiment, the bacteriophage comprises at least one bacteriophage of a strain selected from the Xfas100 phage type or the Xfas300 phage type, described below.

In another aspect, the invention provides an isolated bacteriophage that is virulent to *Xanthomonas axonopodis* a Xfas303 bacteriophage, wherein a representative sample of said bacteriophage has been deposited under ATCC Accession Number PTA-13099. In yet another aspect, the invention provides an isolated bacteriophage that is virulent to *Xanthomonas axonopodis* and/or *X. fastidiosa* as one of bacteriophage selected from the group consisting of: Xfas 101, Xfas102, Xfas103, Xfas104, Xfas105, Xfas106, Xfas107, Xfas108, Xfas 109, Xfas110, Xfas301, Xfas302, Xfas304, Xfas305, and Xfas306, wherein representative samples of said bacteriophage Xfas 103, Xfas 106, Xfas302, Xfas303, Xfas304, and Xfas306 have been deposited under ATCC Accession Number PTA-13096, PTA-13095, PTA-13098, PTA-13099, PTA-13100, and PTA-13097, respectively.

In certain embodiments, the invention provides a method of preventing or reducing symptoms or disease associated or caused by *X. fastidiosa* or *Xanthomonas axoxonopodis* pv. *citri* in a plant comprising a step of contacting said plant with a virulent bacteriophage which includes *X. fastidiosa* and/or *Xanthomonas axoxonopodis* pv. *citri* in its host range, further wherein the bacteriophage is at least one bacteriophage selected from the group consisting of the Xfas100 phage type, and the Xfas300 phage type, wherein the Xfas100 type phage has at least one characteristic selected from the group consisting of (a) the bacteriophage is capable of lysing said *Xylella fastidiosa* and/or *Xanthomonas* bacteria; (b) the bacteriophage infects a cell by binding to a Type IV pili; (c) the phage belongs to a group of tailed bacteriophage exhibiting long non-contractile tails with capsid ranging from 55-77 nm in diameter, a morphology typical of Siphoviridae family; (d) the genomic size of bacteriophage is about 55500 bp to 56200 bp; and (e) the bacteriophage prevents or reduces symptoms associated with Pierce's Disease in a plant or plants; and wherein the Xfas300 type phage has at least one characteristic selected from the group consisting of: (a) the bacteriophage is capable of lysing said *Xylella fastidiosa* and/or *Xanthomonas* bacteria; (b) the bacteriophage infects a cell by binding to a Type IV pilus; (c) the phage belongs to a group of tailed bacteriophage exhibiting short non-contractile tails with capsid ranging from 58-68 nm in diameter, a morphology typical of Podoviridae family; (d) the genomic size of bacteriophage is about 43300 bp to 44600 bp; and (e) the bacteriophage has an activity of preventing or reducing symptoms associated with Pierce's Disease in a plant or plants. In certain embodiments, a single type of virulent bacteriophage is introduced into a plant; in other embodiments, a combination of 2, 3, 4, 5, 6, or more virulent bacteriophage isolates or types are introduced into a plant, either simultaneously or sequentially. In certain embodiments, the bacteriophage comprise a genome with a DNA sequence selected from the group consisting of SEQ ID NO:11-24, or a DNA sequence at least 90%, 95%, 98%, or 99% identical thereto. Thus, in certain embodiments, the bacteriophage to be introduced into a plant is selected from the group consisting of: Xfas101, Xfas102, Xfas103, Xfas104, Xfas105, Xfas106, Xfas107, Xfas110, Xfas301, Xfas302, Xfas303, Xfas304, Xfas305, and Xfas306. Plant disease biocontrol compositions formulated for delivery to a plant, and comprising such Xfas100 and/or Xfas300 type bacteriophage are also contemplated. The biocontrol composition may further comprise a carrier. In some embodiments the carrier may comprise a diluent, a surfactant, and/or a buffer.

BRIEF DESCRIPTION OF THE DRAWINGS

For a more complete understanding of the features and advantages of the present invention, reference is now made to the detailed description of the invention along with the accompanying figures and in which:

FIG. 1: Shows a TEM image of phages Xfas302, Xfas303, Xfas304, and Xfas305, with morphology and size characteristic of Podoviridae.

FIG. 2: Shows a TEM image of phages Xfas101, Xfas102, Xfas103, and Xfas104, with morphology and size characteristic of Siphoviridae.

FIG. 7: Shows a summary of the grapevine bacteriophage therapeutic and preventative challenge study.

BRIEF DESCRIPTION OF THE SEQUENCE LISTING

Figure 3:
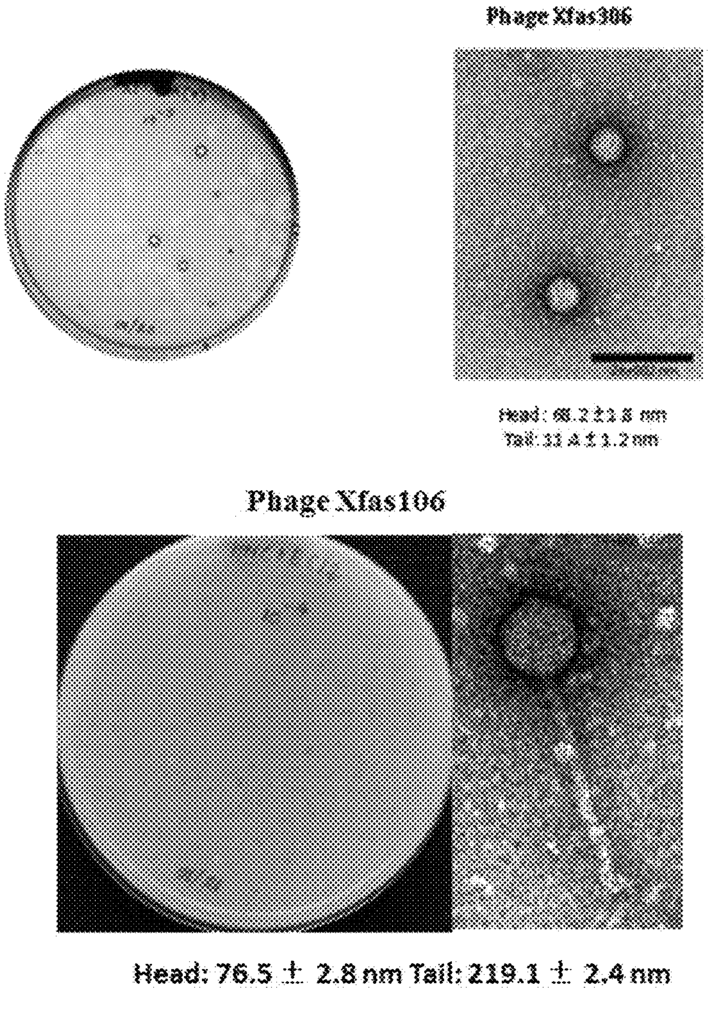
FIG. 3: Shows Podoviridae and Siphoviridae bacteriophages of *X. fastidiosa* isolated from wastewater, able to form plaques on XF15 and EC-12.

SEQ ID NO:1—The *X. fastidiosa*-specific oligonucleotide forward primer designed for *X. fastidiosa* gyrB.

SEQ ID NO:2—The *X. fastidiosa*-specific oligonucleotide reverse primer designed for *X. fastidiosa* gyrB.

SEQ ID NO:3—The bacteriophage Xfas304-specific oligonucleotide forward primer designed for the bacteriophage DNA primase gene.

SEQ ID NO:4—The bacteriophage Xfas304-specific oligonucleotide reverse primer designed for the bacteriophage DNA primase gene.

SEQ ID NO:5—The bacteriophage Xfas303-specific oligonucleotide forward primer designed for the bacteriophage DNA primase gene.

SEQ ID NO:6—The bacteriophage Xfas303-specific oligonucleotide reverse primer designed for the bacteriophage DNA primase gene.

SEQ ID NO:7—The bacteriophage Xfas103-specific oligonucleotide forward primer designed for the bacteriophage DNA helicase gene.

SEQ ID NO:8—The bacteriophage Xfas103-specific oligonucleotide reverse primer designed for the bacteriophage DNA helicase gene.

SEQ ID NO:9—The bacteriophage Xfas106-specific oligonucleotide forward primer designed for the bacteriophage DNA helicase gene.

SEQ ID NO:10—The bacteriophage Xfas106-specific oligonucleotide reverse primer designed for the bacteriophage DNA helicase gene.

SEQ ID NO:11—The genomic sequence of bacteriophage Xfas101.

SEQ ID NO:12—The genomic sequence of bacteriophage Xfas102.

SEQ ID NO:13—The genomic sequence of bacteriophage Xfas103.

SEQ ID NO:14—The genomic sequence of bacteriophage Xfas104.

SEQ ID NO:15—The genomic sequence of bacteriophage Xfas105.

SEQ ID NO:16—The genomic sequence of bacteriophage Xfas106.

SEQ ID NO:17—The genomic sequence of bacteriophage Xfas107.

SEQ ID NO:18—The genomic sequence of bacteriophage Xfas110.

SEQ ID NO:19—The genomic sequence of bacteriophage Xfas301.

SEQ ID NO:20—The genomic sequence of bacteriophage Xfas302.

SEQ ID NO:21—The genomic sequence of bacteriophage Xfas303.

SEQ ID NO:22—The genomic sequence of bacteriophage Xfas304.

SEQ ID NO:23—The genomic sequence of bacteriophage Xfas305.

SEQ ID NO:24—The genomic sequence of bacteriophage Xfas306.

DETAILED DESCRIPTION OF THE INVENTION

The following definitions and methods are provided to better define the present invention and to guide those of ordinary skill in the art in the practice of the present invention. Unless otherwise noted, terms are to be understood according to conventional usage by those of ordinary skill in the relevant art.

The invention provides, for the first time, methods allowing efficient propagation and isolation of bacteriophage (phage) capable of infecting, replicating within, and lysing *X. fastidiosa* and/or *Xanthomonas axonopodis* (Xa) and pathovars thereof. The invention also provides a method for controlling bacterial disease in plants. Plant diseases that may be controlled in accordance with the present invention may include, but are not limited to, Pierce's Disease and citrus canker. Bacterial species useful in accordance with the invention may include, but are not limited, to a *Xylella* species, such as *Xylella fastidiosa*, or a *Xanthomonas* species, such as *Xanthomonas axonopodis* and pathovars thereof, such as *Xanthomonas axonopodis* pv. *citri* (Xac).

As used herein, a "bacteriophage" or "phage" refer to a virus of bacteria. As used herein, "*Xanthomonas axonopodis*" or "Xa" refers to a *Xanthomonas axonopodis* bacterial species or pathovar thereof, which may include *Xanthomonas axonopodis* pv. *citri* (Xac) or any other pathovar of *Xanthomonas axonopodis*. Currently, propagation of bacteriophage capable of lysing *X. fastidiosa* is labor-intensive in the laboratory, using *X. fastidiosa* host cells and complex, expensive media in a solid format. This may require 7-10 days to yield low quantities of bacteriophage. The present invention thus represents a significant advance, providing for propagation of bacteriophage capable of infecting *X. fastidiosa* by growing the bacteriophage in a fast-growing host bacteria such as *Xanthomonas* species EC-12 to rapidly produce bacteriophage; this is designated as the "surrogate host" approach. The technique is fast and cost-effective, capable of use with conventional media components available in the art. The technique is also amenable to scale-up. The ability to produce virulent phages that lyse (kill) *X. fastidiosa* and/or Xa in a surrogate host that can replicate hourly under standard conditions, instead of days using a host that at best replicates daily in a very complex media makes viable for the first time the production and implementation of *X. fastidiosa*- and/or *Xanthomonas axonopodis*-mediated disease control and treatment methods comprising use of virulent phages. Culture of Xa can be performed in nutrient broth with a generation time of approximately 2-3 hours. However, Xa is a permitted pathogen and thus requires a biosafety level of 2 (BL2) to culture. Therefore, similar to *X. fastidiosa*, Xa may not be practical for large-scale production.

Bacteriophage may be isolated by a soft agar overlay method, allowing for isolation of phage from *X. fastidiosa* and/or *Xanthomonas* cells, and in further embodiments, high-titer phage plate lysates are prepared by harvesting one or more overlay plate(s) of a *X. fastidiosa* strain or a *Xanthomonas* strain, such as strain EC-12, exhibiting confluent lysis, followed by maceration, clarification by centrifugation, and filter sterilization. The resulting lysates may be stored at 4° C. Subsequently, high-titer phage lysates may be purified for instance by isopycnic CsCl centrifugation, and extracted phage solution can be dialyzed. Resulting CsCl-purified bacteriophage having a titer of about $1\times10^{11}$ PFU/ml can thus be obtained. In other embodiments, bacteriophage in plant tissue filtrates (PTFs) may be filtered. A preferred ratio for filtration is 1 ml of PTF to 20 ml of the surrogate host culture (an actively growing culture of a selected host), grown, for instance, for 4 days for *X. fastidiosa* strain Temecula or for 4 h for *Xanthomonas* strain EC-12.

Using methods for the detection and propagation of bacteriophage virulent to *X. fastidiosa* and/or *Xanthomonas axonopodis* ("Xa") pathovars, virulent bacteriophage which are capable of causing lysis of *X. fastidiosa* and/or Xa can be selected from a desired source, such as from the environment, including plants, wastewater, and/or soil water, and propagated according to the invention. Bacteriophages that may be identified in accordance with the present invention may be defined by particular characteristics as described by Casjens et al. (*Research in Microbiology,* 159:340-348, 2008), such as capsid shape and size, genome size, arrangement of genes and/or gene modules, morphology, and life cycle. In one embodiment, bacteriophages of the present invention may be virulent, isometric, with a triangulation number of T=7, a genome size of about 60 kb or within about 15% of 60 kb, may include direct terminal repeats in the genome. The virulent bacteriophage can be used, for example, to control and prevent disease cause by *Xylella* species and subspecies and/or *Xanthomonas* species such as *Xanthomonas axonopodis* and pathovars thereof, such as *citri.*

Currently, five subspecies of *Xylella* are recognized as causing plant disease. Plant species able to be infected by *Xylella* are listed, for example, at www.cnr.berkeley.edu/*xylella*/control/hosts.htm, as described in Hernandez-Martinez et al., (*American Phytopathological Society,* 97(7):857-864, 2007) and Nunney et al., (*PLoS ONE,* 5(11):e15488, 2010), and may include commercial crops such as, but not limited to, grapevines, citrus, coffee, almond, peach, alfalfa, apricot, plum, blackberry, mulberry, and horticultural plants such as oleander, oak, sweetgum, redbud, elm, and *Chitalpa tashkentensis*. In one embodiment of the invention, bacteriophage can be isolated from environments where *X. fastidiosa* is unable to grow because of its unique growth requirements. Further, in accordance with the present invention, plant species able to be infected by a *Xanthomonas axonopodis* pathovar may include, but are not limited to, a *Citrus* spp., a *Fortunella* spp., a *Poncirus* spp., a lime, a lemon, an orange, a grapefruit, a pomelo, and hybrids of trifoliate orange used for rootstocks.

The invention thus provides methods for development of bacteriophage-based treatments for the control of plant diseases caused by *X. fastidiosa*, which is a xylem-limited, insect vectored, Gram-negative bacterium that causes disease in many plants. Most notably, *X. fastidiosa* is the causal agent of Pierce's Disease (PD) of grapes, which is currently a limiting factor in the cultivation of high quality wine grapes in areas of the U.S., including Texas and California. One important plant disease caused by *X. fastidiosa* is Pierce's Disease ("PD") of grape, which causes visible symptoms including yellowed leaves, or leaves with red along margins. Eventually drying and necrosis of leaf margins and leaves may occur. Insect vectors such as the leafhopper Glassy Winged Sharpshooter ("GWSS") may spread the disease, as well as phage which infect the disease-causing bacteria and which may be useful for biocontrol efficacy.

Presently, there are no effective control measures for PD short of aggressive culling of the infected vines. The current invention permits treatment of such diseases by providing, for the first time, a viable system for generating sufficient bacteriophage quantities in a cost-effective manner to permit plant treatments. The invention also provides methods for development of bacteriophage-based treatments for the control of plant diseases caused by Xa, including Xac, which is the causal agent of citrus canker. In a particular embodiment, the invention provides a method for controlling disease of Xa in a plant.

As used herein, the term "virulent" refers to a virus, particularly a bacteriophage, that is able to infect, replicate within, and lyse (kill) a host cell. The term "temperate" refers to a bacteriophage that can integrate into the host genome (lysogenize) or lyse the host cell. In one embodiment of the invention, phages are propagated in a suitable host, as is described herein. The term "host" refers to a bacterial cell that can be used to produce large quantities of bacteriophage. One step in the development of a bacteriophage-based control strategy provided herein is the identification and propagation of virulent phages that recognize particular bacterial receptor sites. Production and delivery of bacteriophage virulent to disease-causing bacteria must be economical to represent a viable biocontrol option.

Phages infect a host cell via recognition of receptors, which can include, but are not limited to, surface proteins such as Omp A and OmpF, the core and O-chain of the bacterial LPS in Gram-negative bacteria, sex and type IV pili (e.g. Roine et al., *Mol. Plant Microbe Interact.,* 11:1048-1056 (1998)), and flagella. Without being limited to any given theory, it is believed that bacteriophage may infect *X. fastidiosa* and Xa cells via type IV pili. Thus, in one embodiment, a host according to the present disclosure may be any type of bacteria, and particularly any bacterial species that a virulent temperate bacteriophage, or a derivative thereof, such as a passaged phage, is able to adsorb to and infect via a surface receptor that is required for virulence and/or pathogenicity, such as a type IV pili or a TonB-like protein. By "passaged phage" is meant a phage population which has been propagated by one or more periods of growth in cultured host cells. Typical hosts used in the present invention may be bacterial cells, particularly bacterial species of the family Xanthomonadaceae, which includes both *Xylella* and *Xanthomonas*. In some embodiments, strains of *X. fastidiosa* which may be useful in practicing this invention may include Temecula1 (ATCC 700964); Ann-1 (ATCC 700598); Dixon (ATCC 700965); XF53, XF54, and XF95 (Whitehorn et al., *Science,* 336:351-352 (2012)); XF134, XF136, XF140, XF141, XF15-1, XF15-1-1, TM1 (Jones, et al., *Ann. Rev Phytopathol.,* 45:245-262 (2007)); and tonB1 (Summer et al., *J. Bacteriol.* 192:179-190 (2010)). Exemplary strains of *Xanthomonas*, which are susceptible to one or more of the disclosed bacteriophage isolates, and which may be useful for this invention include EC12, Pres-4, and Jal-4 (provided by Dr. N. Wang, Univ. of Florida, Gainesville, Fla.), Noth 40, Ft. Basinger, and Block22, among others. Other Xanthomonad bacteria may also be utilized in view of their susceptibility to Xfas100 and/or Xfas300 bacteriophage.

As used herein, the term "isolation" is defined as separation and identification of an organism from a solution containing a mixed culture of organisms. Organisms able to be isolated can include viruses, bacteria, plant cells, or the like. Bacteriophage can be isolated as described herein and known in the art. In one embodiment, general laboratory methods for isolating bacteriophage may include but are not limited to growth in cultured cells, bacteriophage assay, double agar method, and plaque assay, among others. The present invention provides a method of isolating bacteriophage by a method involving overlaying at least a first sample comprising different strains of bacterial host cells together in order to isolate bacteriophage able to infect and propagate within both host cell types.

The invention also provides a method of propagating a virus (bacteriophage) virulent to *Xylella fastidiosa* and/or Xa. Methods of propagating bacteriophages are known in the art, and can encompass any method capable of producing quantities of bacteriophage sufficient for treating plant diseases. In one embodiment, propagating bacteriophage virulent to *X. fastidiosa* and/or Xac can comprise growing bacteriophage in *Xanthomonas* bacteria, allowing the bacteriophage to propagate, and isolating bacteriophage particles from the culture.

Bacteriophage virulent to *X. fastidiosa* may be prepared using a soft agar overlay method. High-titer phage plate lysates may be prepared, for instance, by harvesting an overlay plate of *X. fastidiosa* strain Temecula or *Xanthomonas* strain EC-12 exhibiting confluent lysis, followed by maceration and clarification by centrifugation. After being filter sterilized, the resulting lysates can be stored at 4° C. Subsequently, high-titer phage lysates may be purified by isopycnic CsCl centrifugation, and extracted phage solution are dialyzed. CsCl-purified bacteriophage having a titer of, for instance, $1\times10^{11}$ PFU/ml can be obtained.

A preferred ratio of bacteriophage in plant tissue filtrates (PTFs) for filtration is, for instance, 1 ml of PTF to 20 ml of the surrogate host culture (actively growing culture of selected host), grown for 4 days for *X. fastidiosa* strain Temecula or for 4 hours for *Xanthomonas* strain EC-12.

The invention also provides a method of treating or reducing symptoms associated with *X. fastidiosa* and/or Xa pathovars in a plant or plants. Typical Pierce's Disease (PD) symptoms include leaves becoming slightly yellow or red along margins, respectively; eventually leaf margins may dry or die in its zones One embodiment of the contemplated methods involves administering, to a plant infected with *X. fastidiosa* and/or Xa, bacteriophage(s) virulent to *X. fastidiosa* and/or Xa in a manner that will result in treatment of the plant. Treatment of plants for infection may be done by spraying, misting, dusting, injection, or any other method known in the art. Methods for formulating compositions for such applications are also well known in the art. For example, *X. fastidiosa* infects the vascular tissues of plants, and thus the invention as described herein may comprise introducing via injection a purified population of bacteriophage particles virulent to *X. fastidiosa* to a plant infected with *X. fastidiosa* such that the bacteriophage is able to infect and lyse the *X. fastidiosa* cells thereby treating the plant infection. However, one skilled in the art will recognize that other methods may successfully be used, as well. Xa is a foliar pathogen and infects plant leaves, stems, and fruit naturally by rain splashing directly through leaf stomata, or by way of wounds produced during strong winds or by insects. Thus, in one embodiment, the present invention may comprise introducing by spraying a composition comprising a purified population of bacteriophage particles virulent to Xa to a plant infected with Xa.

As used herein, the terms "treatment," "treating," and "treat" are defined as acting upon a disease, disorder, or condition with an agent to reduce or ameliorate the physiologic effects of the disease, disorder, or condition and/or its symptoms. "Treatment," as used herein, covers any treatment of a disease in a host (e.g., a plant species, including those of agricultural interest, such as edible plants or those used to produce edible products, as well as ornamental plant species), and includes: (a) reducing the risk of occurrence of the disease in a plant, (b) impeding the development of the disease, and (c) relieving the disease, i.e., causing regression of the disease and/or relieving one or more disease symptoms. "Treatment" is also meant to encompass delivery of an inhibiting agent to provide an effect, even in the absence of a disease or condition. For example, "treatment" encompasses delivery of a disease or pathogen inhibiting agent that provides for enhanced or desirable effects in the plant (e.g., reduction of pathogen load, reduction of disease symptoms, etc.).

The invention also provides a plant disease biocontrol composition formulated for delivery to a plant, the composition comprising at least one carrier, and at least one bacteriophage that is virulent to *Xylella fastidiosa* and *Xanthomonas* species such as Xa.

The virulent bacteriophage to *Xylella fastidiosa* and/or *Xanthomonas* species such as Xa as an active ingredient in the composition of the present invention is also provided as one of bacteriophage selected from the group consisting of the Xfas100 phage type, such as Xfas101, Xfas102, Xfas103, Xfas104, Xfas105, Xfas106, Xfas107, Xfas108, Xfas109, and Xfas110, and/or the Xfas300 phage type, such as Xfas301, Xfas302, Xfas303, Xfas304, Xfas305, and Xfas306, wherein said phage type of the Xfas103, Xfas106, Xfas302, Xfas303, Xfas304, and Xfas306, which have been deposited under ATCC Accession Numbers PTA-13096, PTA-13095, PTA-13098, PTA-13099, PTA-13100, and PTA-13097, respectively.

The virulent bacteriophage of the Xfas100 phage type as an active ingredient in the present invention displays at least one of the following characteristics: (a) the bacteriophage has an activity of the capable of lysing said *Xylella fastidiosa* and *Xanthomonas* bacteria, (b) the bacteriophage infects a cell by binding to a Type IV pilus, (c) the tailed bacteriophage exhibits long non-contractile tails with capsid ranging from 55-77 nm in diameter, a morphology typical of Siphoviridae family, (d) the genomic size of bacteriophage is about 55500 bp to 56200 bp and (e) the bacteriophage has an activity of preventing or reducing symptoms associated with Pierce's Disease in a plant or plants.

The virulent bacteriophage of the Xfas300 phage type as an active ingredient in the present invention has at least one of the characteristics, wherein said characteristics is; (a) the bacteriophage has an activity of the capable of lysing said *Xylella fastidiosa* and *Xanthomonas* bacteria; (b) the bacteriophage infects a cell by binding to a Type IV pilus; (c) the group of a tailed bacteriophage exhibits short non-contractile tails with capsid ranging from 58-68 nm in diameter, a morphology typical of Podoviridae family; (d) the genomic size of the bacteriophage is about 43300 bp to 44600 bp; and (e) the bacteriophage has an activity of preventing or reducing symptoms associated with Pierce's Disease in a plant or plants. Virulent bacteriophage as an active ingredient in compositions of the present invention further comprises at least one bacteriophage selected from the Xfas100 phage type and/or the Xfas300 phage type, wherein said Xfas100 phage type is Xfas103 and Xfas106 and/or said Xfas300 phage type is Xfas302, Xfas303, Xfas304, and Xfas306.

Bacteriophage virulent to *Xylella fastidiosa* and *Xanthomonas* species, such as Xa, used as an active ingredient in the composition of the present invention is also provided by a combination of phage, such as a cocktail of two, three, four, five, six, or more virulent bacteriophage isolates or types, which may be provided simultaneously or sequentially, including with a carrier. The term "carrier" refers to a diluent, adjuvant, surfactant, excipient, or vehicle with which the phage is administered. Such carriers can be sterile liquids, such as water and oils, including those of petroleum, animal, vegetable or synthetic origin, such as peanut oil, soybean oil, mineral oil, sesame oil and the like. Saline solutions, including phosphate solution such as sodium monohydrogen phosphate, potassium dihydrogen phosphate and aqueous dextrose and glycerol solutions can also be employed as liquid carriers, particularly for injectable solutions. Suitable excipients may include starch, glucose, lactose, sucrose, gelatin, malt, rice, flour, chalk, silica gel, sodium stearate, glycerol monostearate, talc, sodium chloride, dried skim milk, glycerol, propylene glycol, water, ethanol, and the like.

A plant disease biocontrol composition, if desired, may also contain minor amounts of wetting or emulsifying agents, or pH buffering agents.

Protective agents such as, but not limited to, casein based formulations, flour-based formulations, sucrose, Congo red, N-propyl-gallete, and lignin-based formulations, can be added to a plant disease biocontrol composition.

Phage concentration required for efficient disease control is not limited, but for example can be from $1\times10$-$1\times10^{12}$ PFU/ml, $1\times10^{4}$-$1\times10^{11}$ PFU/ml or $1\times10^{7}$-$1\times10^{10}$ PFU/ml.

Depending growing age of tree, the thickness of the stem, the size of the root, the dosage is adjusted appropriately. A plant disease biocontrol composition can be a dry product, a substantially dry product, a liquid product, or a substantially liquid product. In some embodiments, a dry or substantially dry product can be reconstituted in a liquid (e.g., water, etc.), and then applied to a plant. In other embodiments, such a composition can be applied in dry or substantially dry form, where liquid that is already present on the plant, is concurrently applied to the plant, or that subsequently appears on the plant (e.g., by application, condensation, etc.) facilitates exposure of the bacteriophage to target bacteria. In another embodiment, such a composition can be applied by spray, mist, or dust on the plant.

A plant disease biocontrol composition can take the form of a solution, a suspension, an emulsion, a powder, a tablet, and the like.

The timing of application of a plant disease biocontrol composition is not limited, but may for instance be daily, weekly, or twice-weekly, monthly, bimonthly, or quarterly.

The present invention also provides an isolated bacteriophage that is virulent to *Xylella fastidiosa* and *Xanthomonas* species, such as Xa and pathovars thereof.

The invention also provides an isolated bacteriophage as one of bacteriophage selected from the group consisting of the Xfas100 phage type, such as Xfas101-Xfas110, and/or the Xfas300 phage type, such as Xfas301-Xfas306, and wherein Xfas103, Xfas106, Xfas302, Xfas303, Xfas304, and Xfas306, which have been deposited under ATCC Accession Numbers PTA-13096, PTA-13095, PTA-13098, PTA-13099, PTA-13100, and PTA-13097, respectively.

Such a bacteriophage can be detected by confirming the capability of forming plaques on *Xylella fastidiosa* and/or *Xanthomonas* species.

DEPOSIT INFORMATION

A deposit of representative bacteriophage of each of strains Xfas103, Xfas106, Xfas302, Xfas303, Xfas304, and Xfas306, and a deposit of representative bacteria of *X. anopodis* EC-12, which are disclosed herein above and referenced in the claims, was made with the ATCC, located at P.O. Box 1549, Manassas, Va. 20108, USA. The date of deposit for the accessions was Jul. 24, 2012 and the accession numbers for the deposited strains are PTA-13096, PTA-13095, PTA-13098, PTA-13099, PTA-13100, and PTA-13097, respectively. All restrictions upon the deposit will be removed upon the granting of a patent, and the deposit is intended to meet all of the requirements of 37 C.F.R. §1.801-1.809. The deposit will be maintained in the depository for a period of 30 years, or 5 years after the last request, or for the effective life of the patent, whichever is longer, and will be replaced if necessary during that period.

EXAMPLES

The following examples are included to demonstrate preferred embodiments of the invention. It should be appreciated by those of skill in the art that the techniques disclosed in the examples which follow represent techniques discovered by the inventor to function well in the practice of the invention, and thus can be considered to constitute preferred modes for its practice. However, those of skill in the art should, in light of the present disclosure, appreciate that many changes can be made in the specific embodiments that are disclosed and still obtain a like or similar result without departing from the spirit and scope of the invention.

Example 1

Media, Culture Conditions and Bacterial Strains

This example describes the isolation, propagation, and the morphological and genomic characterization of bacteriophage virulent to *X. fastidiosa* and *Xanthomonas* species. The medium used in this study differs from standard medium used to grow *X. fastidiosa*, which allows rapid growth but affects the ability of the bacteriophage to infect. PW broth medium as modified by Sherald et al. (*Plant Disease* 67:849-852, 1983) designated PW-M, was used for growth of *X. fastidiosa* isolates, except that the final bovine serum albumin content was 0.3% as modified by Hill and Purcell (*Phytopathology* 85(12):1368-1372, 1995). For solid medium (PW-MA) and soft agar, the PW-M broth was amended with 15 g/l and 7.5 g/l, respectively, of Plant Cell Culture Tested agar (Sigma). The complex medium TN broth (TNB) was used for routine maintenance of non-*X. fastidiosa* cultures. Solid medium (TNA) was identical, with the exception that it lacked $KNO_3$ and was supplemented with 20 g/L agar. For soft agar overlays, TN medium was amended with 7.5 g/L of agar (TNSA). For plating of plant extracts to obtain total bacterial counts, TNA medium was amended with cycloheximide (40 μg/ml; TNAC). All cultures were grown at 28° C. and liquid cultures were monitored at $\lambda$=600 nm using Nephelo flasks. California *X. fastidiosa* isolates included in the study were Temecula (XF15), which is representative of *X. fastidiosa* subspecies *fastidiosa*, Ann1 (XF108), representative of *X. fastidiosa* subspecies *sandyi*, and Dixon (XF102), representative of *X. fastidiosa* subspecies multiplex (Hendson et al., *Applied and Environmental Microbiology* 67(2):895-903, 2001). Texas *X. fastidiosa* isolates included one each from *Platanus occidentalis* (XF1), *Helianthus annuus* (XF5), *Iva annua* (XF18), *Ambrosia psilostachya* (XF23), *Ratibida columnifera* (XF37), *Vitis aestivalis* (XF39), *Vitis mustangensis* (XF41), three isolates from *Ambrosia trifida* var. *texana* (XF16, 40, and 43), two from *Nerium oleander* (XF93 and 95), and 15 from *Vitis vinifera* (XF48, 50, 52, 53, -54, 56, 58, 59, 60, 66, 67, 70, 71, 76, and 78). All isolates were single-colony purified by the streak isolation method, and stored at −80° C. after amending PW-M broth cultures to a final concentration of 20% glycerol (v/v). *X. fastidiosa* isolates were confirmed at the species and subspecies level using polymerase chain reaction (PCR) analysis as previously described (Hernandez-Martinez et al., *Plant Disease* 90(11):1382-1388, 2006). The MIDI Sherlock® Microbial Identification System that analyzes fatty acid methyl esters by gas chromatography (GC-FAME) was used to identify *Xanthomonas* species.

Example 2

Processing of Plant Samples and Isolation of Bacteria

Plant samples of *Vitis vinifera, V. mustangensis*, and weeds were obtained from vineyards in Brazos County and Washington County, Texas. Rice (*Oryza sativa*) plant tissue and weeds from rice fields were obtained from Jefferson County and Wharton County, Texas. Rice seed samples were obtained from the Texas AgriLife Research Center in Beaumont, Tex. Samples from rose plants (Rosa spp.; Knock Out) and jalapeño (TAM-mild; *Capsicum annuum*) were obtained in Brazos County, Texas. To obtain plant extracts, 10 g of plant tissue were ground using a mortar and pestle in 50 ml bacteriophage buffer (P-buffer; 50 mM Tris-HCl pH 7.5, 100 mM NaCl, 8 mM $MgSO_4$), vortexed, and strained through a double-layer of cheesecloth to remove large particles. The extract was then dilution plated to both PW-M and TNAC for the isolation of *X. fastidiosa* and non-*X. fastidiosa* bacteria, respectively, and incubated at 28° C. Plates were evaluated for growth daily for up to 10 days.

Example 3

Isolation, Purification and Titration of Bacteriophage from Plant Samples

To obtain plant tissue filtrates (PTFs) the clarified plant extract was centrifuged (10,000×g, 10 min at 4° C.), twice and the tissue extract were filtered through a 0.22 μm filter (Supor, Pall Life Sciences). The presence of bacteriophage in PTFs was directly determined by spotting 10 μl of a 10-fold dilution series on overlays of a panel of *X. fastidiosa* and *Xanthomonas* species hosts and observing for zone or plaque formation after lawn development (6-7 days for *X. fastidiosa* isolates and 18 h for *Xanthomonas* species isolates). Alternatively, bacteriophage were enriched from the PTFs by adding 1 ml of each filtrate to 20 ml of an actively growing culture of an *X. fastidiosa* isolate (4 day culture; $A_{600}$=0.30) or an $A_{600}$=0.25 (4 h) culture of a *Xanthomonas* species host. After 72 h or 24 h of growth for the *X. fastidiosa* or *Xanthomonas* species enrichment, respectively, the cultures were centrifuged (10,000×g, 10 min at 4° C.) and filter sterilized (0.22-μm filter). To determine the presence of bacteriophage in the enriched supernatants, 10 μl of a 10-fold dilution series was spotted on overlays of a panel of *X. fastidiosa* and *Xanthomonas* species hosts and observed for zone or plaque formation. Five-day-old cultures of *X. fastidiosa* isolates grown on PW-MA were used to make host suspensions in PW-M broth ($A_{600}$=0.5), whereas 18-h cultures of *Xanthomonas* species isolates grown on medium TNA were used to make suspensions in TN broth ($A_{600}$=0.5), and used to make overlays. Soft agar overlays used to survey bacterial supernatants for bacteriophage activity were made by mixing 100 μl of the bacterial suspension with 7 ml of molten PW-M or TN soft agar, pouring the mixture on PW-MA or TNA plates, and allowing it to solidify and dry. Spotted overlays showing either plaques or cleared zones formation were further investigated by plating as above, except that the PTF dilutions were directly mixed with individual host indicator suspensions before overlaying. Individual plaques formed on either *X. fastidiosa* or *Xanthomonas* species host overlays were excised, suspended in P-buffer and titered. This procedure was repeated three times to obtain a single plaque isolate. High-titer lysates ($1\times10^{10}$ PFU/ml) were prepared by harvesting overlays of plates exhibiting confluent lysis with 5 ml of P-buffer, macerating the soft agar overlay, clearing the lysate by centrifugation (10,000×g, 15 min at 4° C.) and filter sterilizing through a 0.22-μm filter. Lysates were stored at 4° C.

Plant extracts were plated to both PW-M and to TNAC for selection of *X. fastidiosa* and to obtain total bacterial counts, respectively. Plant extracts from all plants assayed did not yield any evidence of *X. fastidiosa* isolates. However, the non-selective plating did yield a large variety of bacterial colony types. Representative single colonies of yellow pigmented bacteria were picked from plates and streak purified to obtain stocks. The stocks were used to make overlays to which the PTFs where spotted to observe for zone or plaque formation. Bacterial isolates Presidio-4, Jal-4, and EC-12 obtained from extracts of rice seed, jalapeno leaves, and rice tissue, respectively, were all identified as *Xanthomonas* species using fatty acid methyl ester analysis by gas chromatography (GC-FAME) and were used as hosts for evaluation of PTFs. Other Xa strains may be utilized as well, in view of the virulence of one or more disclosed bacteriophage on such strains.

Dilutions of several PTFs produced plaques on isolates XF15, XF53, XF54, XF95, after 5 to 6 days of incubation, indicating that bacteriophage able to form plaques on these hosts were present in the plant tissue. Initial titers observed from extracts ranged from $5\times10^1$ to $7\times10^5$ PFU/gram of tissue. Since all PTFs showed the same pattern of production on XF15, XF53, XF54, and XF95, strain XF15 was used as the host for plaque purification and production. The high titer found in this non-enriched PTF indicates that natural bacterial hosts associated with the plant tissue can serve as host for bacteriophage, which can produce plaques on overlays of *X. fastidiosa*. Serial plating of the PTF yielded individual plaques that were uniform in size. Individual plaques were excised and plaque-purified three times using XF15 as the host to obtain clonal isolates. A culture dish of bacteriophage Xfas302 purified and increased using *Xylella fastidiosa* host strain Temecula ($1\times10^9$ PFU (Plaque Forming Units/ml)) and titered on *Xanthomonas* species isolate Pres-4 and EC-12 (both of $5\times10^7$ CFU (Colony Forming Units)/ml), indicating that Bacteriophage Xfas302 propagated on *X. fastidiosa* strain XF15 (Jones et al., 2007) or *X. fastidiosa* Temecula strain (ATCC 700964) was able to form plaques on *Xanthomonas* species strain Pres-4 and EC12 (EC12 deposited under ATCC Accession Number PTA-13101) providing evidence that bacteriophage propagated on *X. fastidiosa* can adsorb, replicate, and form plaques on *Xanthomonas* strains. Host range studies presented below further substantiate these results.

Phages Xfas101-Xfas105 all produced small clear plaques on XF15 lawns, whereas phages Xfas301-Xfas305, produced large clear plaques on the same host. TEM images of Xfas 302-Xfas305 and Xfas101-Xfas104 are shown in FIG. 1 and FIG. 2, respectively. High titer lysates produced using XF15 were used to obtain CsCl-purified preparations of each bacteriophage, which were used to conduct transmission electron microscopy (TEM) studies. Phages Xfas101-Xfas105 all exhibited long non-contractile tails with capsids ranging from 55-64 nm in diameter, and thus were determined to belong to the Siphoviridae family. Xfas301-Xfas305 all exhibited short non-contractile tails with capsids ranging from 58-65 nm in diameter, morphology typical of Podoviridae.

Example 4

Enrichment of Bacteriophage from Wastewater

Clarified wastewater samples were obtained from treatment facilities in the Bryan, Tex. area. Samples were obtained from the Still Creek, Carter Creek, Turkey Creek, and Burton Creek facilities. Samples were centrifuged (10,000×g, 10 min at 4° C.) twice and the tissue extracts were filtered through a 0.22-μm filter. Phages were enriched by adding 1 ml of each filtrate to 20 ml of an actively growing culture of selected hosts as described above. After 72 and 24 h of growth for the *X. fastidiosa* or *Xanthomonas* species enrichment, respectively, the cultures were centrifuged and filter sterilized. The enriched filtrates were spotted to titer on overlays as described above.

Phages Xfas106-109 and Xfas306 were isolated from individually enriched samples obtained from the four wastewater treatment plants using host EC-12 as the host. TEM studies of purified bacteriophage concentrates morphologically identified bacteriophage Xfas306 as Podoviridae by a short non-contractile tail with a capsid of 68 nm in diameter (FIG. 3), whereas phages Xfas106-109 isolated exhibited long non-contractile tails with capsids of ~77 nm in diameter (FIG. 3) characteristic of Siphoviridae. Bacteriophage Xfas306 produced large clear plaques on both hosts EC-12 and XF15, whereas phages Xfas106-109 produced small clear plaques on the same hosts (FIG. 3). Therefore, the method used in this experiment enabled isolation of *X. fastidiosa* bacteriophage from environmental samples.

Example 5

CsCl-Purification

Filter-sterilized bacteriophage suspensions were concentrated by centrifugation (90,000×g for 2.5 h at 5° C.) using a Type 60Ti rotor in a Beckman L8-70M ultracentrifuge. Pellets were resuspended in P-buffer and treated with DNase I and RNase A (Sigma) at a final concentration of 1 μg/ml at 25° C. for 2 h. CsCl was added to the bacteriophage suspension at a final concentration of 0.75 g/ml and centrifuged (300,000×g for 18 h at 5° C.) in a VTi 65.2 rotor. The visible bacteriophage band was extracted using an 18-gauge syringe needle and dialyzed against P-buffer amended to 1 M NaCl overnight at 4° C. and twice for 4 h at 25° C. against P-buffer to obtain a suspension of $1\times10^{11}$ PFU/ml. The CsCl-purified bacteriophage was stored at 4° C.

Example 6

Transmission Electron Microscopy

Electron microscopy of CsCl-purified bacteriophage ($1\times10^{11}$ PFU/ml) was performed by diluting with P-buffer and applying 5 μl onto a freshly glow-discharged formvar-carbon coated grid for 1 min. Grids were then washed briefly on de-ionized water drops and stained with 2% (w/v) aqueous uranyl acetate. Specimens were observed on a JEOL 1200EX transmission electron microscope operating at an acceleration voltage of 100 KV.

Example 7

Efficiency of Plating and Host Range

The efficiency of plating (EOP) was obtained by calculating the ratio of the bacteriophage plaque titer obtained with the heterologous (non-propagating) host to that obtained on the homologous (propagating) host. Bacteriophage stocks were titered on either *X. fastidiosa* or *Xanthomonas* species host using the appropriate medium by mixing 100 μl bacteriophage stock dilutions with individual host indicator suspensions ($A_{600}$=0.5) in soft agar (7 ml) before overlaying on solid medium.

Studies comparing the EOP of Xfas phages are shown in Table 1. The EOP for phages isolated from plant samples propagated using *Xanthomonas* species strain EC-12 and then titered using *X. fastidiosa* strain XF15 as the host, ranged from $1\times10^{-1}$ to $1\times10^{-3}$, with similar results seen when bacteriophage propagated using strain XF15 were then titered using EC-12 as the host. Similar studies with phages isolated from wastewater filtrates and propagated on strain EC-12 exhibited EOPs ranging from $1\times10^{-1}$ to $5\times10^{-1}$. EOPs of $1\times10^{-1}$ to $3\times10^{-1}$ were obtained when phages Xfas106-109 were propagated on strain XF15 and plated on host EC-12, indicating that, while DNA restriction and modification barriers may exist, phages propagated in fast-growing strain EC-12, in one day, can adsorb, replicate and form plaques on *X. fastidiosa*, a process which can take up to 10 days on *X. fastidiosa* alone.

TABLE 1

Efficiency of Plating for Xfas Phages Propagated on *X. fastidiosa* or *Xanthomonas* species hosts

| Bacteriophage Designation | Propagated → Plated XF15 → EC-12 | Propagated → Plated EC-12 → XF15 |
|---|---|---|
| Xfas101 | 3.00E−02 | 5.00E−02 |
| Xfas102 | 3.33E−02 | 5.00E−02 |
| Xfas103 | 1.00E−02 | 3.33E−03 |
| Xfas104 | 4.00E−01 | 5.00E−02 |
| Xfas105 | 1.00E−01 | 1.00E−01 |
| Xfas106 | 1.00E−01 | 2.50E−01 |
| Xfas301 | 5.00E−03 | 1.00E−02 |
| Xfas302 | 1.00E−01 | 5.00E−04 |
| Xfas303 | 2.67E−03 | 1.00E−03 |
| Xfas304 | 1.00E−02 | 5.00E−03 |
| Xfas305 | 1.00E−02 | 5.00E−02 |
| Xfas306 | 3.33E−01 | 3.00E−01 |

Lawns of the host were made by overlaying plates of the appropriate medium, PW-M (for XF15) or TNA (for EC-12) with the homologous soft agar seed with individual host. High titer lysates ($1\times10^{9}$ PFU/ml) of individual bacteriophage preparations were then spot titered on to the individual lawns by spotting 10 μl of a 10-fold dilution series on overlays of the *X. fastidiosa* or *Xanthomonas* species hosts. After incubation of plates at 28° C. for the appropriate times, (24 h for EC-12 or 5-7 days for XF15) plates were evaluated for zones and plaque formation.

Initial host range studies shown in Table 2 indicate that all phages which were able to form plaques on *X. fastidiosa* host XF15 also formed plaques on host EC-12, whereas hosts Jal-4 and Pres 4 exhibited insensitivity to most of the siphophages. Reasons for resistance range from lack of adsorption or other post adsorption mechanism such as bacteriophage-genome uptake blocks, superinfection immunity, restriction modification, and clustered regularly interspaced short palindromic repeats (CRISPRs).

TABLE 2

Host Range of Xfas phages*

| Phages | *Temecula* (XF15) | Hosts EC-12 | Jal 4-1 | Pres 4 | Ann1 (XF108) | Dixon (XF102) |
|---|---|---|---|---|---|---|
| Xfas101 | S | S | S | R | S | S |
| Xfas102 | S | S | S | R | S | S |
| Xfas103 | S | S | R | R | S | S |
| Xfas104 | S | S | R | R | S | S |
| Xfas105 | S | S | S | R | S | S |
| Xfas106 | S | S | R | R | S | S |
| Xfas107 | S | S | R | R | S | S |
| Xfas108 | S | S | R | R | S | S |
| Xfas109 | S | S | R | R | S | S |
| Xfas301 | S | S | R | R | S | S |
| Xfas302 | S | S | S | S | S | S |
| Xfas303 | S | S | S | S | S | S |
| Xfas304 | S | S | S | S | S | S |
| Xfas305 | S | S | S | S | S | S |
| Xfas306 | S | S | R | R | S | S |

*EC-12 host for propagation of phage used in testing.
S = ability to form clear plaques on indicated host; R = not able to form plaques on indicated host.

Example 8

Preliminary Identification of Xfas Adsorption Sites

Based on the observation that *X. fastidiosa* phages obtained or enriched from either plant tissue or wastewater samples formed plaques on *X. fastidiosa* it was of interest to determine if cell surface components could serve as adsorption sites. Known adsorption sites for phages include surface proteins such as OmpA and OmpF, the core and O-chain of the bacterial LPS in Gram-negative bacteria, sex and type IV pili, and flagella. The wild type and a derivative mutant with a deletion of the pilA, resulting in a derivative devoid of type IV pili, were evaluated as hosts for Xfas phages. All bacteriophages tested formed plaques on the XF15 wild type strain but not the XF15ΔpilA mutant. Results suggested that type IV pili may be a primary site of attachment for Xfas phages.

Based on results obtained with XF15-ΔpilA it was of interest to determine if pilA deletion mutants of *Xanthomonas* species strain EC-12 would become insensitive to Xfas phages Xfas103, Xfas106 Xfas302, Xfas303 Xfas304 and Xfas306. Strain EC-12ΔpilA was insensitive to the phages in plate titer assays, and in an adsorption experiment with phage Xfas303 no adsorption to the host was observed. The EC-12ΔpilA-complemented in trans for the pilA was sensitive to all tested phages. This further demonstrated that type IV pili are a primary site of attachment for phages as observed for *X. fastidiosa*.

Example 9

Bacteriophage DNA Isolation and Genome Sequencing

Bacteriophage genomic DNA was prepared from 10-20 ml of filter-sterilized, high-titer (>$1\times10^{9}$ PFU/ml) CsCl-purified bacteriophage lysates using a modified form of the Promega Wizard DNA clean-up kit (Promega). Briefly, 10-20 ml of bacteriophage lysate was digested with 10 μg/ml each of DNase I and RNase A (Sigma) at 37° C. for 30 min and precipitated in the presence of 10% (w/v) polyethylene glycol 8000 and 1 M NaCl for 16-20 h at 4° C. The precipitate was centrifuged at 10,000×g, 4° C. for 10 min and the pellet resuspended in 0.5 ml of P-buffer. One ml of the DNA purification resin supplied with the Wizard kit was added to the resuspended bacteriophage, loaded onto a minicolumn and washed with 2 ml of 80% (v/v) isopropanol. DNA was eluted from the resin by addition of 100 μl of water pre-heated to 80° C. followed immediately by centrifugation of the minicolumn. DNA integrity was verified by running on a 0.8% agarose gel and staining with ethidium bromide and DNA was quantified by band densitometry. Bacteriophage genome size was estimated by pulsed-field gel electrophoresis (PFGE)

analysis of genomic DNA on a 1% agarose gel (Pulsed-Field agarose, BioRad) and comparison to a size marker (MidRange Marker I, NEB).

Phages were sequenced using "454" pyrosequencing (Roche/454 Life Sciences, Branford, Conn., USA, at Emory GRA Genomics Core: Emory Univ., Atlanta, Ga.). Bacteriophage genomic DNA was prepared from bacteriophage isolates as described above and mixed in equimolar amounts to a final concentration of ca. 100 ng/μl. The pooled DNA was sheared, ligated with a multiplex identifier (MID) tag specific for each of the four pools and sequenced by pyrosequencing using a full-plate reaction on a Roche FLX Titanium sequencer according to the manufacturer's protocols. The pooled bacteriophage DNA was present in two sequencing reactions. The reaction contained genomic DNA representing 39 genomic elements totaling ca. 3,331 kb of genomic sequence, and the sequencing run yielded 987,815 reads with an average length of 405 bp, providing a total of 120-fold coverage for the entire pool. The trimmed FLX Titanium flowgram outputs corresponding to each of the four pools were assembled individually using the Newbler assembler version 2.5.3 (454 Life Sciences) by adjusting settings to include only reads containing a single MID identifier per assembly. The identity of individual contigs was determined by PCR using primers generated against contig sequences and individual bacteriophage genomic DNA preparations as template; the generation of the expected size product from a bacteriophage DNA template was used to match individual phages to their contigs. Sequencher (Gene Codes Corporation) was used for sequence assembly and editing. Protein coding regions were predicted using Genemark (opal.biology.gatech.edu/GeneMark/gmhmm2_prok.cgi) and manually edited in Artemis (www.sanger.ac.uk/Software/Artemis/) (Lukashin et al., *Nucleic Acids Research* 26(4):1107-1115, 1998; Rutherford et al., *Bioinformatics* 16(10):944-945, 2000). DotPlots were generated using DOTTER (Brodie et al., *Bioinformatics* 20(2): 279-281, 2004). Predicted proteins were compared to proteins in the GenBank database using BLAST (www.ncbi.nlm.nih.gov/blast/Blast.cgi). Conserved domains, lipoprotein processing signals and transmembrane domains (TMDs) were identified with InterProScan (www.ebi.ac.uk/Tools/webservices/services/interproscan), LipoP (www.cbs.dtu.dk/services/LipoP/), and TMHMM (www.cbs.dtu.dk/services/TMHMM/), respectively.

TABLE 3

Genomic size of Xfas Phages.

| | Family of Morphology | Phage | SEQ ID | ATCC Accession Numbers | Genomic Size (bp) | Identity (bp) | Dice score (% identity over entire genome of Xfas103) |
|---|---|---|---|---|---|---|---|
| Xfas100 Types | *Siphoviridae* | Xfas101 | 11 | | 56,132 | 56,144 | 100.01 |
| | | Xfas102 | 12 | | 56,132 | 56,144 | 100.01 |
| | | Xfas103 | 13 | PTA-13096 | 56,147 | 56,147 | 100.00 |
| | | Xfas104 | 14 | | 56,144 | 56,144 | 100.00 |
| | | Xfas105 | 15 | | 56,144 | 56,144 | 100.00 |
| | | Xfas106 | 16 | PTA-13095 | 55,601 | 31,026 | 55.53 |
| | | Xfas107 | 17 | | | | |
| | | Xfas110 | 18 | | 56,134 | 56,144 | 100.01 |

| | Family of Morphology | Phage | SEQ ID | ATCC Accession Numbers | Genomic Size (bp) | Identity (bp) | Dice score (% identity over entire genome of Xfas303) |
|---|---|---|---|---|---|---|---|
| Xfas300 Types | *Podoviridae* | Xfas301 | 19 | | 44,443 | 33,254 | 75.25 |
| | | Xfas302 | 20 | PTA-13098 | 44,521 | 33,347 | 75.39 |
| | | Xfas303 | 21 | PTA13099 | 43,940 | 43,940 | 100.00 |
| | | Xfas304 | 22 | PTA-13100 | 43,869 | 1,933 | 4.40 |
| | | Xfas305 | 23 | | 43,324 | 43,940 | 100.71 |
| | | Xfas306 | 24 | PTA-13097 | 43,745 | 32,886 | 75.01 |

Dice Score = ((2 × identity)/(Sequence length of both phages)) × 100

Example 10

Genomic Analysis of Xfas Phages and Description of the Xfas100 and Xfas300 Phage Types The phages isolated for their ability to attack *Xanthomonas* EC-12 and *X. fastidiosa* and subspecies that all require the type IV pili for infection and are all virulent, in that no lysogenic colonies can be isolated from infections and no genes associated with temperate life style (repressor, integrase) are found in the genome sequences. The phages can be further classified in two phage types, as defined by Casjens et al. (*Research in Microbiology,* 159:340-348, 2008).

Figure 4:
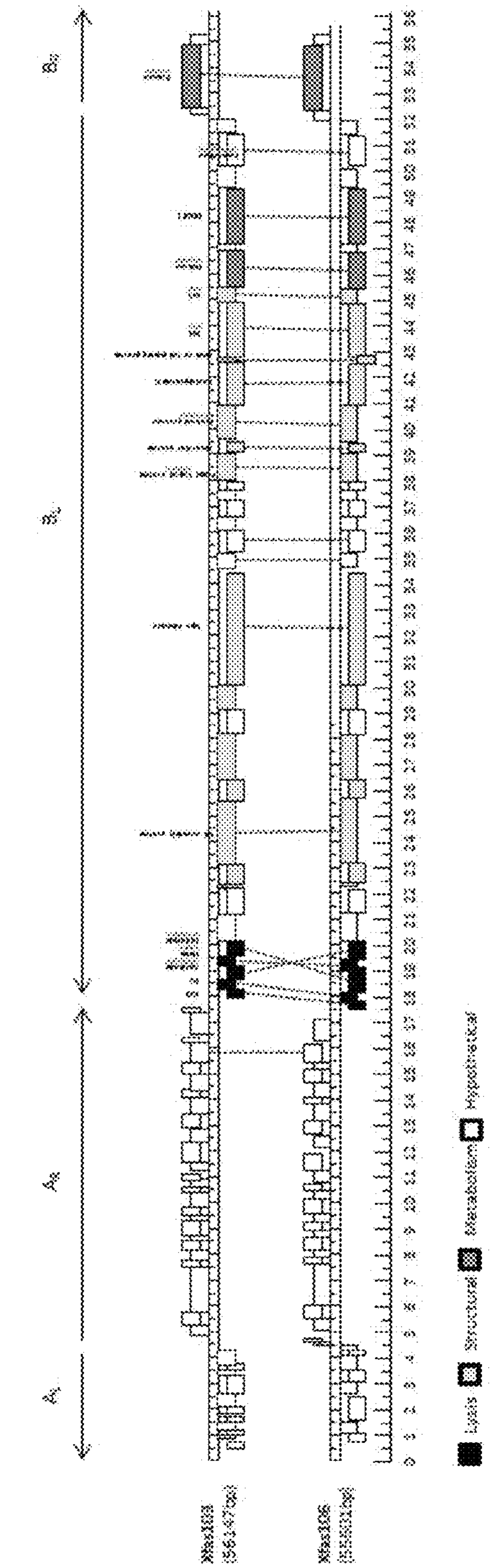
FIG. 4: Shows a genomic map of Siphoviridae Xfas103 and Xfas106.

(1) Xfas100 phage type: The Xfas100 phage type is comprised of virulent Siphophages (ICTV Siphoviridae) of *Xanthomonas* and *Xylella*, the prototypes of which are the phages Xfas101, Xfas102, Xfas103, Xfas104, Xfas105, Xfas106, Xfas107, Xfas108, Xfas109, and Xfas110 (Table 12) and further examples of which are listed in Table 3 as any phage designated "Xfas1nn," where n is any number (referred to as the Xfas 100 series). This flexible nomenclature system is necessary because it is anticipated that further variants of the Xfas 1nn phage type will be isolated. Xfas100-type phages are siphophages, are virulent in life-style, and require the type IV pili for infection of *Xylella* and *Xanthomonas* species. Xfas100-type phages have icosahedral capsid heads measuring approximately 55-77 nm in diameter and flexible tails of approximately 200-262 nm in length; both dimensional values are as determined within the standard precision of negative-stain electron microscopy (see FIGS. 2 and 3). The Xfas100 series viral DNA has cohesive (cos) ends characterized by single-stranded DNA overhangs (Casjens, et al.,

*Methods Mol Biol* 502:91-111, 2009), which is important for phages to be used in antibacterial applications because cos DNA packaging avoids the generation of generalized transducing particles that would potentiate the transfer of pathogenesis determinants. The Xfas100 genome has a characteristic overall organization (see FIG. 4) with the genes arrayed in two divergent gene clusters, $A_L$ and $A_R$ and $B_L$ and $B_R$. The Xfas100 phage type is further distinguished by the fact that the essential structural and lysis genes of the phage are grouped in rightward gene cluster $B_L$. The Xfas100 series phage type is also distinguished by encoding its own single-molecule DNA polymerase (Xfas103gp71 and Xfas106gp66), primase (Xfas103gp76 and Xfas106gp71) and helicase (Xfas103gp69 and Xfas106gp64).

Figure 5:
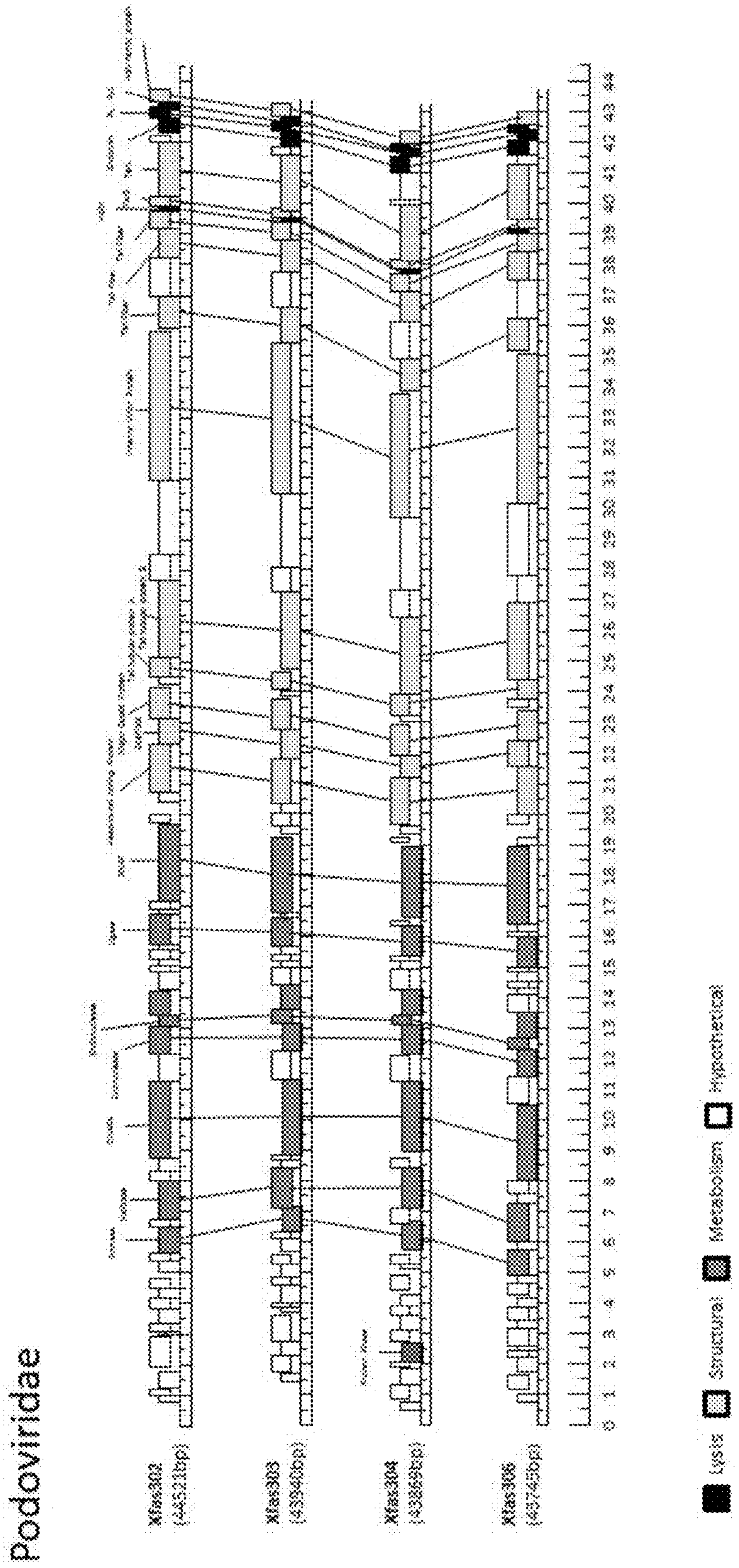
FIG. 5: Shows a genomic map of Podoviridae Xfas302, Xfas303, Xfas304, and Xfas306.

(2) Xfas300 phage type: The Xfas300 phage type is comprised of virulent podophages (ICTV Podoviridae) of *Xanthomonas* and *Xylella*, the prototypes of which are the phages Xfas301, Xfas302, Xfas303, Xfas304, Xfas305, and Xfas306, and further examples of which are listed in Table 3, and refers to any phage with the designation "Xfas3nn" where n is any number (referred as Xfas300 series). This flexible nomenclature system is necessary because it is anticipated that further variants of the Xfas300 phage type will be isolated. Xfas300-type phages have icosahedral capsid heads measuring approximately 58-68 nm in diameter; this dimensional value is as determined within the standard precision of negative-stain electron microscopy (see FIGS. 1 and 3). The Xfas302-306 genome encodes a single-subunit RNA polymerase located adjacent to the structural protein region. The Xfas300 series genome has a characteristic overall organization (see FIG. 5) with the genes arrayed on one strand, including the replication, structural and lysis genes of the phage. The Xfas300 phage type is also distinguished by encoding its own single-molecule DNA polymerase (Xfas302gp18, Xfas303gp17, Xfas304gp17 and Xfas306gp17), single-subunit RNA polymerase (Xfas302gp31, Xfas303gp28, Xfas304gp27 and Xfas306gp30, respectively and helicase (Xfas302gp15, Xfas303gp14, Xfas304gp15 and Xfas306gp14 (see FIG. 5 for schematic of phage genome).

Example 11

Movement, Challenged and Protection Studies in Grapevines Using Bacteriophage Xfas304

Bacteriophage Xfas304, is a member of the family Podoviridae, isolated from environmental samples that has a host range that includes both *X. fastidiosa* and *Xanthomonas* species. In the studies presented here, the movement and persistence of Xfas304 was determined in grapevines in the absence of a sensitive host, in order to determine whether treatment of a plant with bacteriophage may prevent subsequent infection by *X. fastidiosa*. Additionally, grapevines that were first inoculated with *X. fastidiosa* were then challenged 4 weeks post-pathogen-inoculation with bacteriophage Xfas304, to determine if the bacteriophage could control the development of Pierce's Disease therapeutically.

For the preventative studies, grapevines were inoculated with 40 μl of a bacteriophage Xfas304 suspension ($1\times10^{10}$ PFU/ml) and then challenged 4 weeks post-bacteriophage-inoculation with *X. fastidiosa*. Bacterial *X. fastidiosa* suspensions used for inoculation were adjusted spectrophotometrically ($A_{600}$=0.4; $1\times10^9$ CFU/ml). Individual cordons were inoculated between the second and third node on opposite sites (two points/cordon) with 40 μl of the bacterial suspension using the needle inoculation technique as described by Hopkins (*Plant Dis.* 89:1348-1352, 2005). Control vines were mock inoculated with phosphate buffer at the same point of inoculation of the above.

The results indicated that bacteriophage Xfas304 can be used to treat and prevent Pierce's Disease caused by *X. fastidiosa* subspecies *fastidiosa* in grapevines. Thus, bacteriophage Xfas304 and other virulent *Xylella-Xanthomonas* phages identified from these studies have potential use in the protection and treatment of plants against diseases caused by other *X. fastidiosa* subspecies and *Xanthomonas* species.

Bacteria used in the study included *X. fastidiosa* strains Temecula (XF15) and XF54, associated with Pierce's Disease of grapevines in California and in Texas, respectively. Cultures of *X. fastidiosa* were maintained on PW-M agar medium (Summer et al., *J Bacteriol* 192(1): 179-190, 2010) at 28° C. for 5-7 days. Five-day-old cultures of the *X. fastidiosa* isolates grown on PW-MA were used to make bacterial suspensions in phosphate buffer (0.125 M, pH 7.1) for vine inoculations.

Dormant *V. vinifera* cv. Cabernet Sauvignon clone 08 on 1103P rootstock were purchased from Vintage Nurseries (Wasco, Calif., USA), Vines were planted in 7-gallon pots using 101 Sunshine Mix 1 (Sun Gro Horticulture, Vancouver, British Columbia, Canada). Plants were grown in a greenhouse on a 16-h light (26° C., 300-400 μE/$m^2$·s)/8-h dark (18° C.) cycle supplemented with illumination from sodium vapor lamps. Plants were irrigated every other day with tap water. Every 15 days, the vines were fertilized with Peter's General Purpose 20-20-20 fertilizer and micronutrients. Plants were progressively pruned to provide uniform plants as follows: upon producing two unbranched solitary shoots of 100-150 cm, two shoots were pruned to 80 cm. Lateral shoots and buds were removed. Two cordons were staked and allowed to grow until each cordon was −2.5-2.75 m in length before vines were used for the above-experiments.

Figure 6:
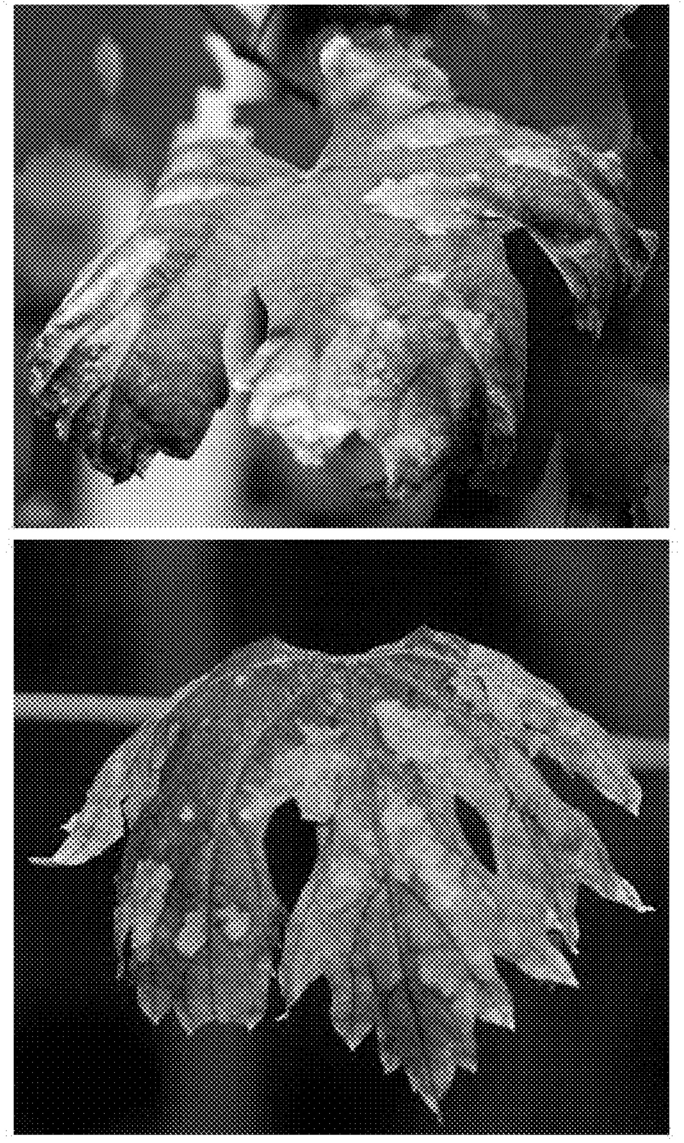
FIG. 6: Shows a grapevine plant exhibiting symptoms of Pierce's Disease 8 weeks after inoculation with strain XF54 and not challenged with bacteriophage.

Standard qRT-PCR line plots were obtained for *X. fastidiosa* strains XF15 and XF54, as well as for bacteriophage Xfas304, all of which had $R^2$ values of greater than 0.9 and efficiencies of 157%, 130%, and 123%, respectively. Quantitative assessment of duplicate cordons from triplicate samples of XF15 and XF54 showed distribution of the pathogens throughout all segments assayed, with typical Pierce's Disease (PD) symptoms visible, such as leaves become slightly yellow or red along margins, respectively, and eventually leaf margins dry or die in its zones by week 8 post-inoculation (FIG. 6). In vines inoculated with bacteriophage Xfas304, in the absence of a permissive host, a progression in the distribution of bacteriophage at weeks at 2, 4, and 6 weeks post-inoculation was observed, with a decline between weeks 8-12 and no vine symptoms.

Example 12

Grapevine Inoculation with Bacteria and Bacteriophage

For therapeutic evaluation of bacteriophage treatment, 15 vines (two cordons each) were inoculated with *X. fastidiosa* strains XF15 or XF54. Bacterial suspensions used for inoculation were adjusted spectrophotometrically ($A_{600}$=0.4; $1\times10^9$ CFU/ml). Average of qRT-PCR results from three segments (e.g. 1/1a, 1/1b, 1/1c) with similar locations from triplicate vines was used to determine the CFU/gram plant tissue (gpt) and PFU/gpt. Individual cordons were inoculated between the second and third node on opposite sites (two points/cordon) with 40 μl of the bacterial suspension using the needle inoculation technique as described by Hopkins (*Plant Dis.* 89:1348-1352, 2005). Control vines were mock inoculated with phosphate buffer following the same protocol. Four week post-inoculation with the pathogen, the 15 vines from each treatment were challenged with 40 μl of a bacteriophage Xfas304 suspension ($1\times10^{10}$ PFU/ml) using the same inoculation protocol and technique. Vines were scored for symptom development twice weekly for 12 weeks and assayed in triplicate for *X. fastidiosa* and bacteriophage at the time of inoculation, and at 8, 10, and 12 weeks, as described below. To determine if bacteriophage could act in a preventative manner, nine vines (two cordons each) were inoculated with 40 μl bacteriophage Xfas304 using the same inoculation protocol and inoculation technique as the above. At four weeks post-bacteriophage inoculation, the vines were challenged with 40 μl ($A_{600}$=0.4; $1\times10^9$ CFU/ml) of strain XF15 using the same inoculation protocols as the above.

To evaluate the bacterial and bacteriophage movement in the grapevine, 15 vines each were inoculated with either XF15 or XF54 and 24 vines were inoculated with only bacteriophage Xfas304 using the same inoculation protocols as the above. Vines inoculated with XF15 or XF54 were assayed in triplicate immediately after inoculation and at weeks 8, 10, and 12 post-inoculation. Vines inoculated with bacteriophage were assayed in triplicate immediately after inoculation and every two weeks for 12 weeks. Methods for assay are described below.

To determine how bacteriophage would affect pathogen populations and disease development in vines, *X. fastidiosa* inoculated vines were challenged with bacteriophage Xfas304 at four weeks post-pathogen inoculation. At 8 weeks post inoculation with XF15, vines challenged with Xfas304 at week 4 showed no PD symptoms and the bacterial populations were one to three logs lower in bacteriophage challenged vines as compared to non-challenged vines. The non-bacteriophage challenged plants showed PD symptoms (FIG. 7, column 2), whereas the bacteriophage challenged vines showed no PD symptoms after week 5 (FIG. 7, column 6). During weeks 8 through 12 post-XF15 inoculation (weeks 4 through 8 post-Xfas304 challenge), no PD symptoms were observed in bacteriophage-challenged vines and XF15 populations continued to decline to almost non-detectable levels as compared to non-bacteriophage challenged vines.

A quantitative evaluation of the bacteriophage population in the presence and absence of an introduced host (XF15) indicated that the bacteriophage were able to replicate in sensitive hosts growing in the vines and declined in the absence of a sensitive hosts. Experiments with strain XF54 challenged with Xfas304 at 4 weeks post-pathogen inoculation showed similar results to that observed for XF15 challenged vines. The XF54 population in vine extracts, as measured by CFU/ml of extract, declined from weeks 8 through 12 in bacteriophage challenged vines as compared to that observed in non-bacteriophage-challenged vines. At weeks 8 through 12 post XF54 inoculation (weeks 4 through 8, post-Xfas304 challenge), no PD symptoms were observed in bacteriophage-challenged vines (FIG. 7, column 7). The bacteriophage population increased over the post challenge period in the presences of XF54 and decreased in the absence of a host, again indicating that the bacteriophage was able to replicate in sensitive hosts when present in vines. A summary of the challenge study is presented in FIG. 7, showing that in XF15 or XF54 inoculated vines challenged with bacteriophage Xfas304 (week 4 post-pathogen inoculation) no additional PD symptoms were observed after week 5 (FIG. 7, columns 6 and 7), whereas symptom developed through week 9 and 10 in non-bacteriophage challenged vines inoculated with strain XF15 or XF54, respectively (FIG. 7, columns 2 and 3).

Additional studies were conducted with vines inoculated with bacteriophage Xfas304 and then challenged with XF15 at week 4 post-bacteriophage inoculation to determine the protective (prophylactic) potential of the bacteriophage treatment. At weeks 4 and 8 post-challenge with XF15 vines showed no PD symptoms (FIG. 7, column 8), whereas non-phage treated vines developed symptoms (FIG. 7, column 2). The bacteriophage population increased from week 8 to 12 post challenge period in the presences of XF15 and decreased in the absence of a host.

These results confirm that bacteriophage treatment prevents or reduces PD symptoms by *X. fastidiosa* in a plant and that phage treatment causes no adverse effects to a plant.

Example 13

Sample Collection and Processing

Duplicate cordons from each vine were divided into 5-6 segments and segments were numbered from bottom to top. Each segment was homogenized using a PRO250 homogenizer with 20×115 mm generator (PRO Scientific, CT, USA) in 15 ml of P-buffer (50 mM Tris-HCl, pH 7.5, 100 mM NaCl, 8 mM $MgSO_4$), filtered through sterile cheesecloth (Fisher Scientific, USA) to remove plant tissue debris. For assaying bacteriophage, the filtrate was centrifuged (10,000×g for 15 min) and filter sterilized. The filtrate was used for bacteriophage DNA extraction. The same protocol was used for bacterial assays, except the pellet was resuspended into 1 ml of Milli-Q water for bacterial DNA extraction.

Example 14

Propidium Monoazide (PMA) Treatment of Samples

The PMA protocol as described by Nocker (*J Microbiol Meth* 67:310-20, 2006) was used to exclude dead cells of *X. fastidiosa* from assays used to develop standard curves for assays and for assaying of vine tissue extracts. Briefly, PMA (Biotium Inc., Hayward, Calif.) was dissolved in 20% dimethyl sulfoxide (Sigma-Aldrich, Germany) to yield a stock solution of 20 mM and stored in the dark at −20° C. A volume of 1.25 μl of the PMA stock solution was added to 500 μl *X. fastidiosa* cell suspensions ($A_{600}$=0.4; $1\times10^9$ CFU/ml) or extracts from control and inoculated vines. Preparations were incubated in clear microcentrifuge tubes in the dark for 5 min with repeated inversion. Following incubation, the microcentrifuge tubes were placed on ice and exposed to a 650-W halogen light source (Ushio, USA) at a distance of 20 cm for 1 min. The tubes were swirled briefly by hand every 15 s and inverted after 30 s of illumination to ensure complete cross-linking of the available DNA and the conversion of free PMA to hydroxylamino propidium. After photo-induced cross-linking, viable cells were collected by centrifugation at (12000×g for 2 min at 25° C.) and washed with 500 μl sterile distilled water and resuspended Mili-Q water for DNA extraction.

Bacterial DNA was extracted from PMA treated cell preparations and vine extracts using a ZR Fungal/Bacterial DNA Miniprep (Zymo Research, USA) as per the manufacturer's instructions.

Bacteriophage DNA from control preparations and from plant extracts was extracted using Wizard DNA Clean-up system (Promega, Wis., USA) with modifications as described by Summer (*Methods Mol. Biol.* 502:27-46, 2009).

Example 15

Detection of *X. fastidiosa* and Bacteriophage Xfas304 Using Real Time-PCR

A SYBR-green based Real Time-PCR (RTPCR) was performed on the 7500 Real-Time PCR System (Applied Biosystems, CA, USA) using the *X. fastidiosa*-specific primers INF2 5'-GTTTGATTGATGAACGTGGTGAG-3' (SEQ ID NO:1) and INR1 5'-CATTGTTTCTTGGTAGGCATCAG-3' (SEQ ID NO:2) designed for the gyr B (Bextine and Child, *FEMS Microbiology Letters* 276: 48-54, 2007), and bacteriophage Xfas304-specific primers 304-PrimF 5'-AAGAAGCGTGGTTTGTTTGC-3' (SEQ ID NO:3) and 304-PrimR 5'-CTACCGGCTTCCCTAACTCC-3' (SEQ ID NO:4) designed for the DNA primase gene. A master mix was made using 10 μl of Express SYBR GreenER SuperMix (Invitrogen), 0.4 μl of both primers (at a concentration of 10 μM), 8.56 μl of sterile molecular grade water, 0.04 μl of ROX reference dye (Invitrogen), and 1 μl DNA template per reaction. Standardized conditions were used for all reactions with an initial denaturing step of 3 min at 95° C., followed by 40 cycles of the following parameters: 95° C. for 30 s, 55° C. for 30 s, and 72° C. for 30 s. At the end of the PCR, the temperature was increased from 72 to 99° C. at a rate of 0.5° C./10 s, and the fluorescence was measured every 10 s. Each DNA sample was analyzed in triplicate. As a positive control, DNA was extracted from *X. fastidiosa* cells and from bacteriophage Xfas304 lysates using methods described the above. Cycle threshold (Ct) values, describing the PCR cycle number at which fluorescence rises above the base line, were determined using the software package provided by the Applied Biosystems.

To determine the Standard curve for absolute quantification, 1-ml volumes of XF15 and XF54 cell suspensions of $1\times10^8$ CFU/ml were treated using the PMA protocol. Bacterial DNA was extracted as described above, serially diluted from $1\times10^{-1}$ to $1\times10^{-5}$ and subjected to the real-time PCR assay described above. Similarly, bacteriophage DNA was extracted from 1 ml volume of $1\times10^9$ PFU/ml bacteriophage Xfas304 as described above, diluted from $1\times10^{-1}$ to $1\times10^{-6}$ and subjected to the real-time PCR assay. Three replicates of each sample for *X. fastidiosa* and bacteriophage Xfas304 were used to produce the standard curves. Standard curves were constructed by plotting Ct values generated from real-time PCR against *X. fastidiosa* DNA concentrations (Log DNA conc./μl as determined by $A_{260}$). The efficiency (E) was calculated as follows: $E=10^{(-1/slope)}-1$ (Klein et al., *Electrophoresis* 20:291-299, 1999).

Example 16

Lysogen Formation Assay Studies

To assay for phage lysogen-formation, survivors of phage infection were tested for the presence of prophages. For each phage, bacteria were infected with at an input MOI of ~3 and plated in a soft agar overlay. Plates were monitored for colony growth (10-15 days for *X. fastidiosa* strain Temecula and 2-3 days for *Xanthomonas* strain EC-12). Individual colonies that emerged were picked, purified (three times) and re-tested for phage sensitivity by spotting dilutions of the same phage in a soft agar overlay. Primer pairs specific to the Xfas 103 and Xfas 106 helicase gene, or Xfas 303 and Xfas 304 primase gene (Table 5) were then used to test for the presence of prophage sequences in the phage-insensitive isolates. Wild type bacterial DNA was used as negative control and wild type bacterial DNA spiked with phage DNA served as positive controls.

To test whether evidence could be found for abortive lysogeny (i.e., the establishment of repression), we followed the procedure of Gill et. al (Gill J. J., et al., *J. Bacteriol.,* 193: 5300-5313 (2011)), except reversibly bound phage were removed by three successive washes. Liquid cultures of logarithmically growing *Xanthomonas* strain EC-12 were cultured to an OD600 of ~0.3-0.5. One ml aliquots were pelleted by centrifugation and resuspended in 0.20 ml of phage lysate (harvested in TNB) or sterile TNB. After a 30 min incubation at 25° C. cell-phage mixtures were centrifuged and the supernatant removed and titered to determine adsorbed phage. In preliminary experiments it was determined that phage were reversibly bound, which affected the MIOactual calculation (Kasman, L. M., et al., *J. Virol.,* 76:5557-5564 (2002)). To circumvent this problem and to obtain an accurate MOIactual, cells were resuspended in sterile TNB, allowed to incubate for 5 min at 25° C., centrifuged and supernatants removed. This procedure was repeated three times to remove unbound phage. Each supernatant was titered to determine PFU. Cell pellets were resuspended in 0.20 ml of sterile TNB, serially diluted and plated to enumerate the bacterial survivors remaining following phage exposure. From these data, the MOIactual, i.e., the ratio of the number of adsorbed phage to the number of CFU in the phage-free controls) was calculated. These MOIactual values were used to calculate the predicted proportion of uninfected cells using the Poisson distribution. This experiment was replicated three times, using both Xfas 103 and Xfas 303.

Lysogeny.

To examine the potential for lysogeny, 40 phage-insensitive isolates of *X. fastidiosa* strain Temecula and *Xanthomonas* strain EC-12 each were recovered following a challenge by phage Xfas 103, Xfas 106, Xfas 303 or Xfas 304. PCR using phage specific primers did not detect the presence of phage lysogens in resistant isolates, indicating resistance was not due to lysogeny. Additionally, the potential for abortive lysogeny was examined using infection at a high MOI and measuring survival (Gill et. al (2011)). As shown in Table 4, following infection, there was no significant difference between predicted and actual survivors, indicating phage infection at a high MOI did not lead to the establishment of repression. Together, these results indicate there is no evidence for lysogeny or repression, supporting the conclusion that the four phages are virulent.

TABLE 4

Predicted bacterial survivors based on MOIactual compared to measured bacterial survivors of *Xanthomonas* strain EC-12 following exposure to phage Xfas 103 or Xfas 303a.

| | Replicate No. | $MOI_{actual}$ | Predicted % surviving cells | Measured % surviving cells | Fold excess of survivors vs. prediction |
|---|---|---|---|---|---|
| Xfas 103 | 1 | 6.51 | 0.15 | 0.12 | 0.8 |
| | 2 | 5.57 | 0.38 | 0.25 | 0.65 |
| | 3 | 5.99 | 0.30 | 0.24 | 0.80 |
| Xfas 303 | 1 | 5.40 | 0.45 | 0.38 | 0.80 |
| | 2 | 5.39 | 0.45 | 0.49 | 1.08 |
| | 3 | 5.52 | 0.40 | 0.37 | 0.92 |

aPredicted survivors were calculated from the Poisson distribution for the measured MOIactual. Data shown are from three independent replicate experiments.

Example 17

Phage Cocktail Protection and Prevention Studies

Bacterial Strains, Phages, and Inoculum Preparation:

Bacterial isolates used in the study were *X. fastidiosa* strains Temecula (XF15) and XF54 (see Example 3). Cultures of *X. fastidiosa* were maintained on PW-M as described in Example 1. XF15 and XF54 inocula were prepared as described in Example 11. High-titer phage lysates of Xfas303, Xfas304, Xfas103 and Xfas106 ($1\times10^{10}$ PFU/ml) were prepared and titered as described in Example 3. The phage cocktail was prepared by mixing each of the four phages to obtain a final concentration of $1\times10^{10}$ PFU/ml for each phage in the cocktail.

Grapevine Inoculation with Bacteria and Phage Cocktail:

Grapevines were inoculated with either *X. fastidiosa* strain XF15 or XF54 to evaluate bacterial movement in the grapevine. Grapevines were assayed in triplicate immediately after inoculation (0 min) and at 8 and 12 weeks post-inoculation. Additionally, grapevines inoculated with XF15 or XF54 were challenged 3 weeks post-inoculation with the phage cocktail to evaluate therapeutic efficacy. Phage cocktail-inoculated grapevines were challenged at week 3 post-phage inoculation with either XF15 or XF54 to evaluate preventative efficacy of the cocktail. Grapevines from each treatment were scored for symptom development twice weekly. To determine distribution of individual phages comprising the cocktail, grapevines were assayed at weeks 0, 2, 4, 6, 8, 10, and 12 post-inoculation as described below. Grapevines inoculated in either phage or pathogen challenge studies were assayed for phage and/or *X. fastidiosa* infection at weeks 0, 6, 8, 10, and 12 as described below. Control grapevines were assayed at 0, 8, and 12 weeks post inoculation to monitor pathogen distribution and disease development. All grapevine assays were conducted in triplicate with vines containing two cordons. Each cordon (e.g. Cordon1=S1, or Cordon2=S2) was divided into 5-6 (5 inch) segments. Vine segments were numbered from point of inoculation (0) and numbered as below (−) or above (+) the point of inoculation in 5 inch segments. The root portion was divided into three segments: R1, R2, or R3.

Sample Collection and Processing:

For quantification of cocktail phages and pathogens, samples were obtained as described in Example 13. For assaying of phages, the filtrate was centrifuged (10,000×g at 4° C. for 15 min) and filter sterilized. The filtrate was used for phage DNA extraction to accomplish quantitative real-time PCR (qRTPCR) (See below). The same protocol was used for bacterial assays except the pellet was resuspended into 1 ml of Milli-Q water for isolation of bacterial DNA used in qRT-PCR. Average of qRTPCR results from three segments (e.g. 0a,0b,0c) with similar locations from triplicate vines was used to determine the CFU and PFU. To determine if phage-resistant *X. fastidiosa* would develop as a result of phage challenge experiments, samples collected from grapevines at week 12 post-pathogen inoculation were processed as described in Example 13. Briefly, 100 μl of a suspension of the pellet in 1 ml Milli-Q was plated on PW-MA (Example 1) supplemented with 40 μg/ml cycloheximide (PW-MAC) and incubated at 28° C. After 10-12 days, individual colonies were picked and streak-purified 3 times on PW-MAC. Representative individual colonies (20 colonies total) from each grapevine sample were confirmed at the species and subspecies level using PCR analysis as described by Hernandez-Martinez et al. (Example 1). Phage sensitivity of confirmed isolates was determined by the serial dilution spot assay on overlays and soft agar overlay method as described in Example 3.

PMA Treatment and qRTPCR:

PMA treatment and SYBR-green based qRTPCR protocols were conducted as described in Example 15 using *X. fastidiosa*-specific primers INF2 (SEQ ID NO:1) and INR1 (SEQ ID NO:2) and bacteriophage-Xfas303 specific primers 303-PrimF (SEQ ID NO:5) and 303-PrimR (SEQ ID NO:6), Xfas304 specific primers 304-PrimF (SEQ ID NO:3) and 304-PrimR (SEQ ID NO:4), Xfas103-specific primers 103-HelF (SEQ ID NO:7) and 103-HelR (SEQ ID NO:8); and Xfas106-specific primers 106-HelF (SEQ ID NO:9), and 106-HelR (SEQ ID NO:10) listed in Table 5.

TABLE 5

Primers used for qRT_PCR (SEQ ID NOs. 1-10).

| Primer Set | Sequence | Specific organism and gene | Reference |
|---|---|---|---|
| INF2<br>INR1 | GTTTGATTGATGAACGTGGTGAG<br>CATTGTTTCTTGGTAGGCATCAG | *Xyella fastidiosa*, gyr B | Bextine and Child, 2007 |
| 303-PrimF<br>303-PrimR | AACTACCTGACAGCGACT<br>CGTACTAGCTTGGCTTCTA | Xfas303, primase | This work |
| 304-PrimF<br>304-PrimR | AAGAAGCGTGGTTTGTTTGC<br>CTACCGGCTTCCCTAACTCC | Xfas304, primase | This work |
| 103-HelF<br>103-HelR | AACCTGATCTGGTACGAC<br>GGACATTTTTCAGTTCTCTC | Xfas103, helicase | This work |
| 106-HelF<br>106-HelR | CAACCTCATCTGGTATGAC<br>GTCTTGGGTAATTTCTTTCT | Xfas106, helicase | This work |

*All PCR reactions were conducted for 40 cycles with denaturation at 95° C. for 30 sec, annealing at 55° C. for 30 sec and extension at 72° C. for 30 sec.

Movement of *X. fastidiosa* and Disease Development in Grapevines:

Quantitative assessment of duplicate cordons from triplicate samples of XF15 or XF54 inoculated grapevines showed pathogen distribution in grapevine segments assayed. qRT-PCR detected the presence of an average of $1\times10^4$ and $1\times10^5$ CFU/gm of plant tissue (gpt) of XF15 in segment (Seg) S1/1 (cordon 1, 5 inch segment 1 above the point of inoculation) and S2/1 respectively, and an average of $1\times10^4$ CFU/gpt of XF54 in S1/2 and S2/2 at week 8-post inoculation. Typical Pierce's Disease symptoms were visible, such as leaves becoming slightly yellow or red along margins, and leaf margins dried or necrotic by week 8, post-inoculation in non-cocktail challenge grapevines. At week 12 post-inoculation, an average of $1\times10^4$ and $1\times10^6$ CFU/gpt of XF15 was detected in S1/3 and S2/2, respectively. At the same assay interval, an average of $1\times10^5$ and $1\times10^4$ CFU/gpt of XF54 was detected in S1/3 and S2/1, respectively, at week 12 post inoculation, with grapevines exhibiting PD symptoms. Both pathogens (XF15 and XF54) were detected in the root system of grapevines at weeks 8 and 12 post pathogen inoculation at an average of $1\times10^1$-$1\times10^2$ CFU/gpt.

Figure 8:
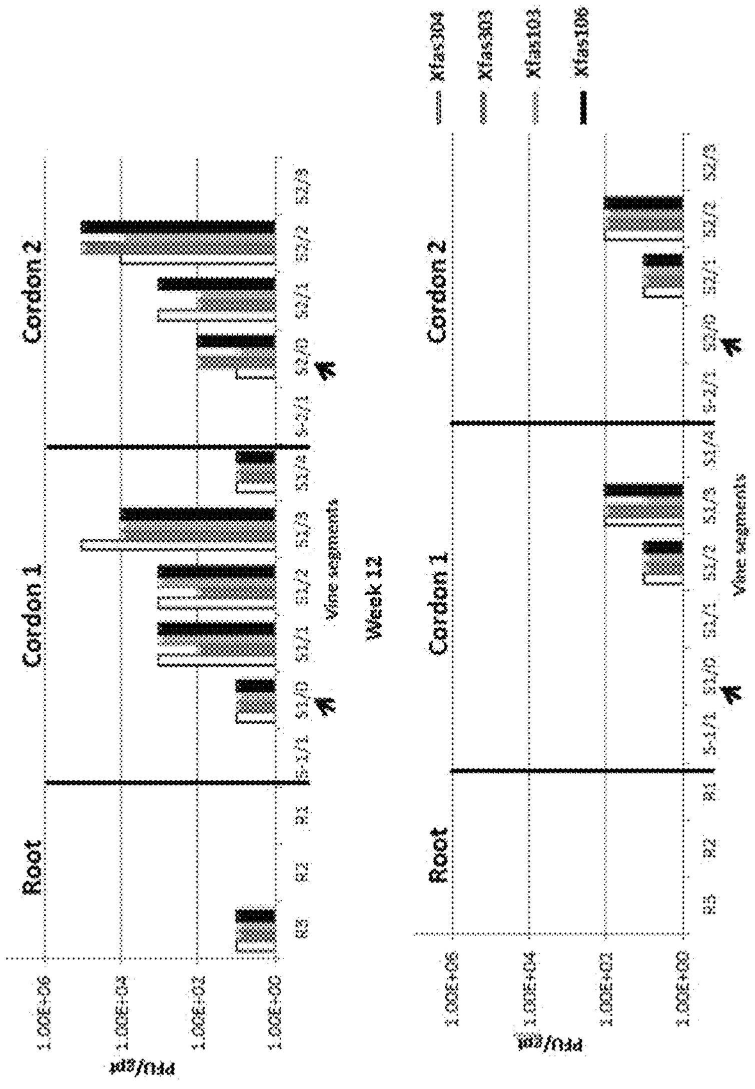
FIG. 8: Shows movement and persistence of individual bacteriophages in inoculated grapevines at 8 (Top) and 12 (Bottom) weeks after phage inoculation. Left panel: phages present in root tissue. Middle panel: phages present in cordon 1 of grapevine. Right panel: phages present in cordon 2 of grapevine.

Phage Movement and Persistence in Grapevines:

Standard qRTPCR line plots were obtained for phage Xfas303, Xfas304, Xfas103, and Xfas106 that had R2 values of greater than 0.9 and efficiencies of 127%, 123%, 129%, and 120%, respectively. Quantitative assessment of duplicate cordons from triplicate samples of grapevines inoculated with phage cocktail (Xfas303, Xfas304, Xfas103, and Xfas106) showed distribution of all phages individually within grapevine segments assayed at weeks 2-8-post-cocktail inoculation (FIG. 8). By weeks 8 and 12, individual phages were no longer detectable in roots and had declined to an average of $1\times10^1$-$1\times10^2$ PFU/gpt by week 12 in segments assayed with no grapevine symptoms observed (FIG. 8).

Figure 9:
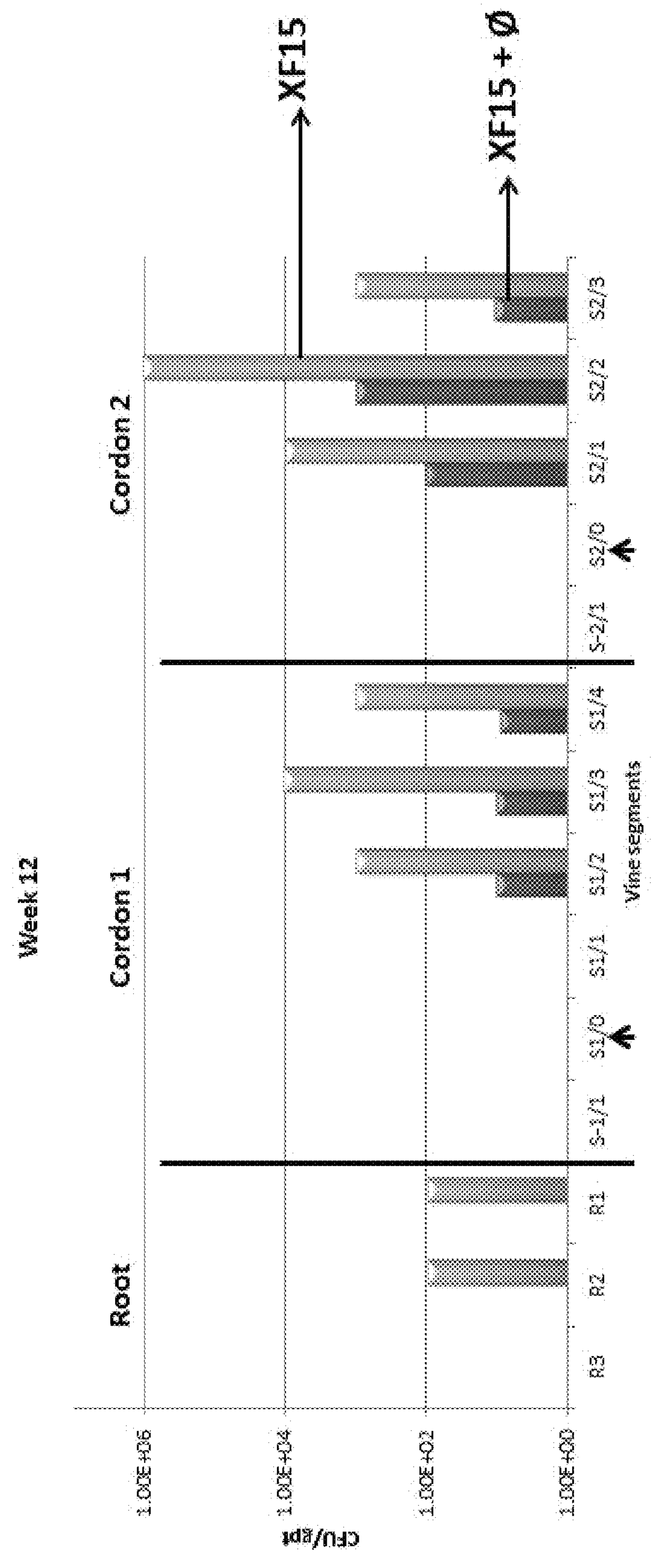
FIG. 9: Shows levels of XF15 in inoculated grapevines challenged with phage cocktail 3 weeks later. Samples were collected 9 weeks after phage cocktail challenge (12 weeks after bacterial inoculation). Left panel: bacteria present in root tissue. Middle panel: bacteria present in cordon 1 of grapevine. Right panel: bacteria present in cordon 2 of grapevine. Gray bars show XF15 levels in XF15 inoculated vines. Black bars show XF15 levels in XF15 inoculated vines challenged with phage cocktail at week 3-post pathogen inoculation. Arrows show segment with point of inoculation. Each bar is representative of average CFU/gpt (gram plant tissue) of roots and 2 cordons for 3 vines.

Therapeutic Efficacy of Phage Against *X. fastidiosa* in Grapevines:

Grapevines inoculated with XF15 were challenged with the phage cocktail at three weeks post pathogen inoculation. At 8 weeks (5 weeks post cocktail challenge), the XF15 population was an average of 2-3 logs higher in non-challenged grapevines compared to challenged grapevines. Non-therapeutically treated grapevines showed typical PD symptoms, whereas challenged grapevines did not. At week 12 post-XF15 inoculation (9 weeks post-cocktail challenge), bacterial populations were an average of 2-3 logs higher in non-challenged grapevines when compared to phage cocktail challenged grapevines (FIG. 9). PD symptoms were not observed in phage challenged grapevines throughout the trial (12 weeks), whereas non-cocktail treated grapevines exhibited symptoms as early as 4 weeks, which progressed through week 12. Similarly, the bacterial population in grapevines challenged with XF54-inoculated cocktail declined significantly from weeks 8 through 12 compared to non-challenged grapevines, with no symptoms observed in cocktail-challenged grapevines. Plating of plant extracts from 12-week cocktail-challenged grapevines yielded an average of $1\times10^2$ CFU/gpt. Representative isolates (20 ea) confirmed as *X. fastidiosa* from each cordon of each of three grapevines were all sensitive to the four phages that composed the cocktail.

Prophylactic Efficacy of Cocktail Treatment for the Prevention of PD in Grapevines:

Prophylactic efficacy of the phage cocktail was evaluated by first inoculating grapevines with the cocktail and then challenging with *X. fastidiosa* strain XF15 or XF54 at week 3 post-cocktail inoculation. Grapevines treated prophylactically showed no PD symptoms at weeks 8 and 12 post-cocktail inoculation. In cocktail-inoculated grapevines that were challenged with XF15, pathogen populations reached a maximum of an average of $1\times10^3$ CFU/gpt in the segments of the grapevines examined at weeks 8 and 12, and as high as an average of $1\times10^6$ CFU/gpt in non-prophylactically treated grapevines. Similar results were observed in grapevines treated prophylactically with cocktail and then challenged with XF54 at week 3 post phage cocktail inoculation. Plating of plant extracts from 12-week cocktail challenged-grapevines yielded an average of $3\times10^2$ CFU/gpt. Representative isolates (20 ea) confirmed as *X. fastidiosa* from each cordon from each of three grapevines were all sensitive to the four phages that composed the cocktail.

Figure 10:
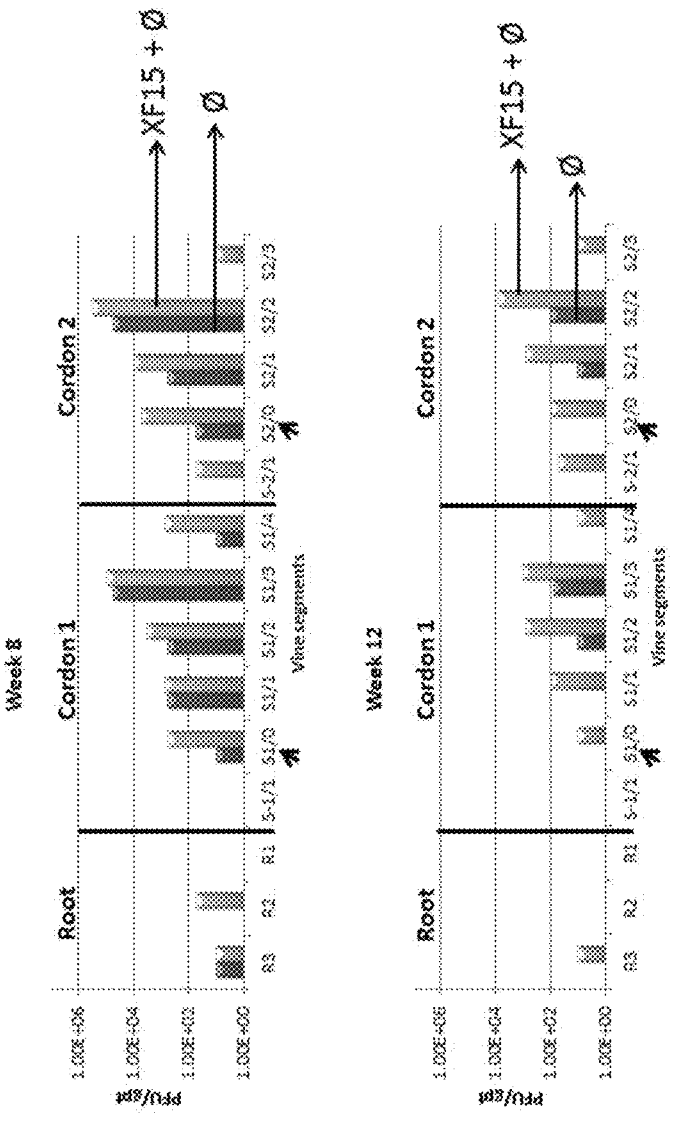
FIG. 10: Shows levels of cocktail phages in grapevines initially inoculated with XF15 and challenged with phage cocktail 3 weeks later. Samples were collected 5, 7, and 9 weeks after phage cocktail challenge (8, 10, and 12 weeks after initial bacterial inoculation). Left panel: phages present in root tissue. Middle panel: phages present in cordon 1 of grapevine. Right panel: phages present in cordon 2 of grapevine. Black bar show phage levels in cocktail inoculated plants. Gray bar show phage levels in XF15 inoculated vines challenged with phage cocktail at week 3-post pathogen inoculation. Arrows show segment with point of inoculation. Each bar is representative of the average PFU/gpt (gram plant tissue) of 4 phages in cocktail determined from roots and 2 cordons for 3 vines.
Figure 11:
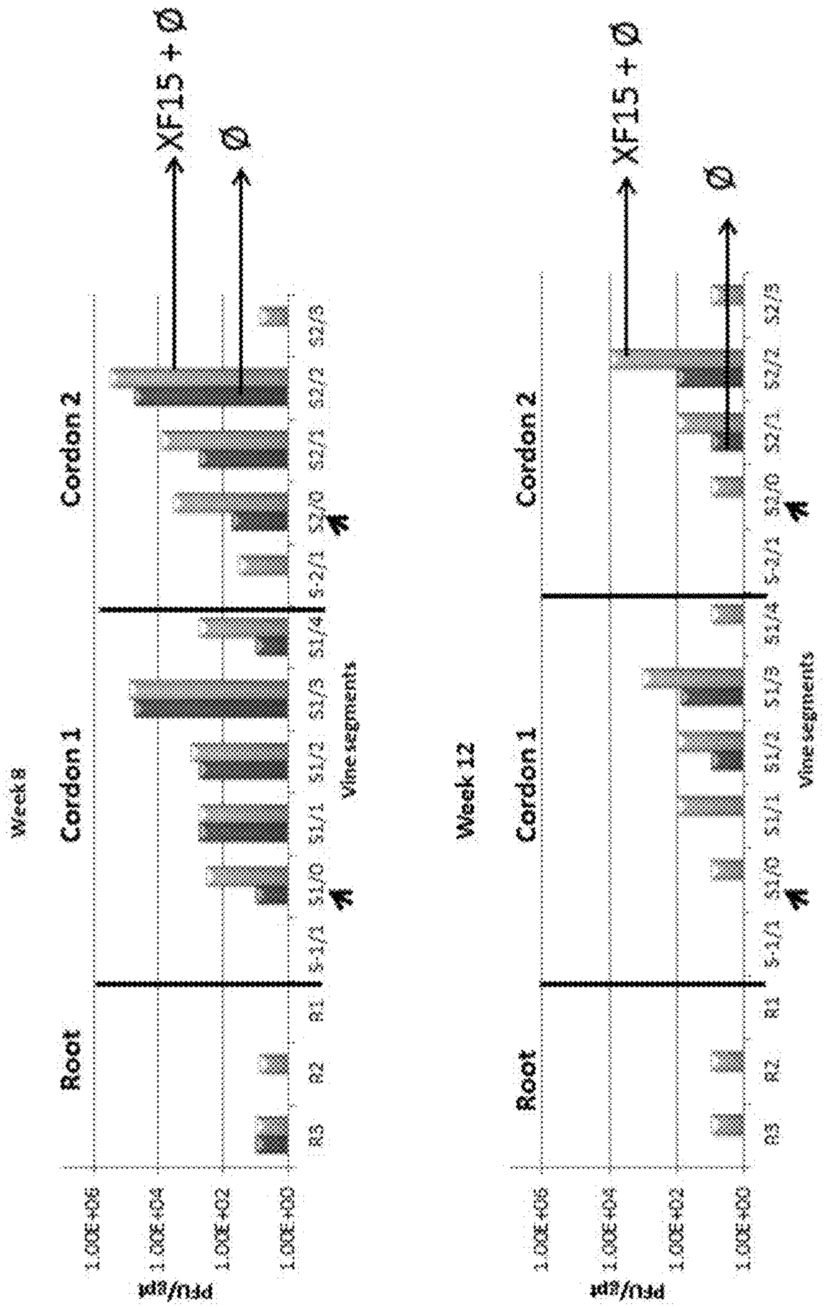
FIG. 11: Shows levels of phages in grapevines initially inoculated with phage cocktail and challenged 3 weeks later with XF15. Samples were collected 5, 7, and 9 weeks after XF15 challenge (8, 10, 12 weeks after initial phage inoculation). Left panel: phages present in root tissue. Middle panel: phages present in cordon 1 of grapevine. Right panel: phages present in cordon 2 of grapevine. Black bars show phage levels in cocktail inoculated vines. Gray bars show phage levels in cocktail inoculated vines challenged with XF15 at week 3-post phage inoculation. Arrows show segment with point of inoculation. Each bar is representative of the average PFU/gpt (gram plant tissue) of 4 phages in cocktail determined from roots and 2 cordons for 3 vines.

Persistence and Replication of Phages in Grapevines:

It was of interest to determine phage populations in grapevines in the presence or absence of introduced hosts (XF15 and XF54). Quantitation of phage populations in the presence or absence of hosts confirmed that the cocktail phages were able to replicate and maintain higher populations if sensitive hosts were present in grapevines and then declined in the absence of a sensitive host in both the therapeutic and prophylactic studies (FIGS. 10 & 11). Phage populations in non-host containing grapevines decreased during weeks 8-12, whereas phage populations increased an average of 1-2 logs during the same period in grapevines inoculated with XF15 or XF54 and challenged (therapeutic treatment) with phage cocktail (FIG. 10). Similar results were obtain in prophylactic study, with phage populations increasing an average of 1-2 logs over that observed in non-host containing grapevines (FIG. 11). These results confirmed that bacteriophage treatment prevents or reduces PD symptoms by *X. fastidiosa* in a plant and demonstrates no adverse effect to a treated plant.

Example 18

Transmission of *X. fastidiosa* by the Glassy-Winged Sharpshooter

The glassy-winged sharpshooter (GWSS), *Homalodisca vitripennis*, is a xylem-feeding leafhopper that transmits *X. fastidiosa*. The GWSS is prevalent throughout grape growing regions of southern California and Texas. Laboratory-reared *X. fastidiosa*-free GWSSs were fed on cowpea (*Vigna unguiculata* subsp. *unguiculata*) plants harboring either *X. fastidiosa* or virulent phage Xfas304 for 48 h in three trials to examine the uptake of *X. fastidiosa* or phage by GWSS. To determine the ability of GWSSs to transmit bacteria or phage to plants, GWSSs harboring bacteria or phage were fed on bacteria and phage-free plants. A subset of bacteria harboring GWSSs were challenged by feeding them on plants harboring phage for 48 or 96 h. GWSSs and plants were assayed individually in all experiments to evaluate uptake, transmission or persistence of bacteria and/or phage using qRTPCR. GWSSs were able to uptake and transfer *X. fastidiosa* and/or phage. In GWSSs harboring *X. fastidiosa* and challenged with phage, the titer of phage Xfas304 increased two-fold, as compared to that observed in *X. fastidiosa*-free GWSSs. A two-fold decline in bacterial population was observed in GWSSs when challenged with phage Xfas304, as compared to non-challenged. GWSSs transmitted *X. fastidiosa* and/or phage to plants. It is believed that this is the first report of phage transfer by GWSSs.

Bacterial Strains, Phages and Inoculum Preparation:

*X. fastidiosa* strain XF54 (See Example 1) and phage Xfas304 (See Example 3) were used in this study. Culture of XF54 was grown on PW-M as described in Example 1. Five-day-old culture of XF54 grown on PW-MA was used to make bacterial suspensions in phosphate buffer (0.125 M, pH 7.1). High-titer phage lysate of Xfas304 ($1\times10^{10}$ PFU/ml) was prepared and titered as described in Example 3 in sterile deionized water (SDW).

Plant Growth Conditions and Preparation:

Cowpea (*Vigna unguiculata* subsp. *unguiculata*) plants were grown in 3-inch pots using Metro-Mix and maintained at 24° C. to 29° C. (16 and 8 h of light and darkness, respectively) and watered as needed.

Glassy-Winged Sharpshooter:

Laboratory-reared GWSSs were originally reared for multiple generations in greenhouses at either of two sites: (i) California Department of Food and Agriculture (CDFA), Arvin or (ii) University of California Cooperative Extension, San Marcos, Calif. All GWSSs used in this study were adult males and females and were transported from the above two sites. After receiving, insects were fed on cowpea plants maintained at 24° C. to 29° C. (16 and 8 h of light and darkness, respectively), for two days to adapt in the new climate before being used in experiments.

Experimental Design:

Each experimental unit (i.e., cage) contained a 15-cm-long stem of cowpea at the 3-4 leaf stage and a 50 ml flat-bottom tube with a 50-ml suspension of phage or bacteria in SDW as appropriate. Cowpea stems with attached leaves at the 3-4 leaf stage (cut stem) were collected from two- or three-week-old plants inserted through a hole in the cap and anchored in place with Parafilm (cut stem anchored). GWSSs (3 GWSS/cut stem/cage) were placed in cages and allowed to feed as appropriate.

Uptake of *X. fastidiosa* and Phage by GWSSs:

To determine uptake of *X. fastidiosa* and/or phage by GWSSs, cowpea cut stems with attached leaves were anchored in a tube filled with an *X. fastidiosa* ($1\times10^9$ CFU/ml) or phage Xfas304 ($1\times10^{10}$ PFU/ml) suspension for 4 h to allow for capillary uptake of *X. fastidiosa* or phage. Control cut stems were placed in SDW. After allowing cut stems to uptake the appropriate suspension for 4 h, a subset (3 cut stems) was assayed to quantify *X. fastidiosa* or Xfas304. After the 4-h uptake period, GWSSs (3 GWSSs/cut stem/cage) were allowed to feed on cut stems. Each experimental set was done in triplicate (1 cut stem×3 GWSSs X 3 cages). After 48 h, all cowpea cut stems and GWSSs were assayed to quantify the presence of *X. fastidiosa* and/or phage by qRTPCR. Water uptake controls were conducted for all experiments under the same conditions and assayed for *X. fastidiosa* and phage.

Initial experiments were designed to determine if GWSSs could acquire *X. fastidiosa* or phage from cut stems that harbored the pathogen or phage, and if so, whether they could transfer the *X. fastidiosa* or phage to other cut stems. After 48 h, cut stems and GWSSs harbored an average of $2\times10^8\pm1\times10^8$ CFU/g of plant tissue (gpt) and $1\times10^6\pm0.7\times10^6$ CFU/GWSS, respectively confirming that GWSSs could acquire *X. fastidiosa* as previously reported (Bextine et al., *Biotechniques* 38:184, 186, 2005). In a parallel experiment to determine if phage could be acquired by GWSSs from feeding on cut stems, GWSSs assayed after 48 h harbored an average of $2\times10^6\pm0.9\times10^6$ PFU/GWSS that was acquired from cut stems containing $2\times10^8\pm1\times10^8$ PFU/gpt. The results showed that GWSSs could acquire phage by feeding on cut stems.

Uptake and Transfer of Phage by GWSSs:

To determine phage uptake and transfer by GWSSs, cowpea cut stems (9) were anchored in 50-ml tubes filled with phage Xfas304 suspension ($1\times10^{10}$ PFU/ml). Controls (3 cut stems) were placed in SDW. Both sets of cut stems were allowed to uptake respective medium. After 4 h, three of the cut stems allowed to uptake phage were assayed to determine phage concentration. The remaining 6 cut stems were each placed in individual cages with GWSSs (3 GWSSs/cut stem/cage). After 48 h, 9 GWSSs and their respective 3 cut stems were assayed for phage content and the remaining 9 GWSSs were transferred to fresh cowpea cut stems anchored in SDW (3 GWSSs/cut stem×3 cages) and allowed to feed for an additional 48 h to determine phage transfer to cut stems. Cut stems (3) and GWSSs (9) were assayed for phage after the designated period. Water uptake controls were conducted for all experiments under the same conditions and assayed for phage.

Having determined that both phage and bacteria could be acquired by GWSSs, it was of interest to determine if GWSSs that acquired phage from cut stems could transfer phage and/or bacteria to another cut stem. A subset of phage-harboring GWSSs were transferred to fresh cowpea cut stems in SDW and allowed to feed. After 48 h, the cut stems and GWSSs harbored an average of $3\times10^2\pm2.5\times10^2$ PFU/gpt and $3\times10^3\pm1.6\times10^3$ PFU/GWSSs, respectively, indicating that GWSSs could transfer phage.

Phage Challenge of *X. fastidiosa* Harboring GWSSs:

To determine if phage could affect the *X. fastidiosa* population in GWSSs, GWSSs harboring *X. fastidiosa* were challenged with phage. Briefly, using methods described above with triplicate replicates, GWSSs fed on *X. fastidiosa*-containing cut stems, verified to contain *X. fastidiosa*, were transferred to cowpea cut stems uptaking phage Xfas304 and allowed to feed. After 48 or 96 h of feeding, the cut stems and GWSSs were assayed for phage and/or *X. fastidiosa*. For uptake of *X. fastidiosa*, cowpea cut stems (15) were place in a XF54 suspension ($1\times10^9$ CFU/ml) for 4 h before introducing GWSSs. At 4 h, 3 cut stems were assayed for *X. fastidiosa*. Each of the 12 remaining cut stems were placed in cages with 3 GWSSs/cut stem and the GWSSs allowed to feed for 48 h on the *X. fastidiosa*-containing cut stems. After 48 h, the *X. fastidiosa*-fed GWSSs and host cut stems were subdivided into 3 groups: Group 1 was assayed for *X. fastidiosa* (3 cut stems and 9 GWSSs); Group 2 (9 GWSSs) was transferred to fresh cowpea cut stems (3) placed in SDW and allowed to feed for 48 h before GWSSs and cut stems were assayed for *X. fastidiosa*; Group 3 (18 GWSSs) was transferred to cowpea cut stems (3) placed in a XFas304 suspension ($1\times10^{10}$ PFU/ml) and allowed to feed for 48 or 96 h before the GWSSs and cut stems were assayed for *X. fastidiosa* and phage. Water uptake controls were conducted for all experiments under the same conditions and assayed for both *X. fastidiosa* and phage.

36 GWSSs were allowed to feed on cowpea cut stems in a *X. fastidiosa* suspension and then assayed to determine *X. fastidiosa* uptake, *X. fastidiosa* and/or phage transfer, and effect on phage and/or *X. fastidiosa* in GWSSs. GWSSs (Group 1) allowed to feed on cut stems for 48 h that had been placed in a suspension of the *X. fastidiosa* strain XF54 ($3\times10^9$ CFU/ml) were determined to harbor on the average $1\times10^6\pm0.7\times10^6$ CFU/GWSSs and the host feeding cut stems were determined to harbor an average of $2\times10^8\pm1\times10^8$ CFU/gpt. After GWSSs harboring *X. fastidiosa* (Group 2; $1\times10^6\pm0.7\times10^6$ CFU/GWSS) were allowed to feed on fresh cut stems in SDW for 48 h, the cut stems showed an average of $1\times10^3\pm1.3\times10^3$ CFU/gpt and the GWSSs an average of $2\times10^3\pm1\times10^3$ CFU/GWSSs residual *X. fastidiosa*; reconfirming previous results of *X. fastidiosa* transfer by GWSSs. Group 3 of the *X. fastidiosa* harboring GWSSs transferred to cut stems in an Xfas304 suspension ($2\times10^{10}$ PFU/ml) and allowed to feed for 48 h, showed uptake of phage and persistence of *X. fastidiosa*. The assayed GWSSs, at 48 h of feeding, harbored an average of $3\times10^4\pm1.8\times10^4$ PFU/GWSS of Xfas304 and retained $2\times10^3\pm1.1\times10^3$ CFU/GWSSs of XF54. The cut stems assayed at the same time interval contained an average of $3\times10^8\pm2\times10^8$ PFU/gpt and $2\times10^3\pm0.6\times10^3$ CFU/gpt. The GWSSs allowed to feed for 96 h harbored an average of $2\times10^5\pm1.2\times10^5$ PFU/GWSS of Xfas304 and $1\times10^2\pm0.9\times10^2$ CFU/GWSS of XF54, indicating a reduction in XF54 and an average 6-fold increase in Xfas304.

Collection and Assay of Cowpea Cut Stems and GWSSs:

GWSSs were sacrificed by freezing at −20° C. for 5 min and cowpea cut stems were collected by cutting at the junction of the tube cap with sterile razor. Each GWSS of each triplicate was placed into 1.5-ml micro-centrifuge tube with 0.5 ml of P-buffer (50 mM Tris-HCl, pH 7.5, 100 mM NaCl, 8 mM $MgSO_4$), homogenized using a sterile plastic micro-pestle (Fisher), and filtered through sterile cheesecloth (Fisher Scientific, USA) to remove tissue debris. Each cut stem of each of triplicate was weighed and commuted using a sterile razor blade and homogenized in 1 ml of P-buffer using a mortar and pestle and filtered through sterile cheesecloth (Fisher Scientific, USA) to remove tissue debris. For assaying phage, the filtrate was centrifuged (10,000×g for 15 min) and filter sterilized. A portion of filtrate was used for phage DNA extraction as in Example 9, followed by qRTPCR as described below. The remaining portion of the filtrate was used to titer phage as described in Example 3. The same protocol was used for bacterial assays (CFUs), except the pellet was resuspended into 0.5 ml of sterile Milli-Q water for PMA treatment, bacterial DNA extraction, and qRTPCR as described below.

PMA Treatment and qRTPCR:

PMA treatment and SYBR-green based qRTPCR protocols were conducted as described in Example 17 using *X. fastidiosa*- and phage-specific primers.

Example 19

Phage Activity Against *Xanthomonas axonopodis* pv. *citri*

Figure 12:
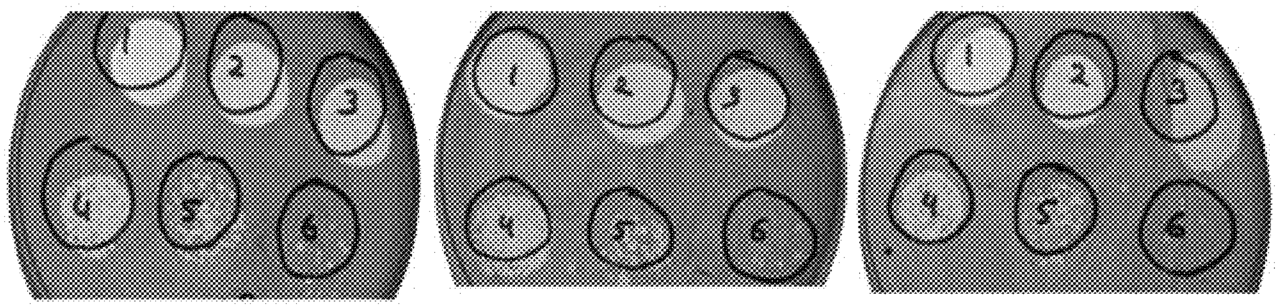
FIG. 12: Shows results of spot titration of phage Xfas303 on *Xanthomonas axonopodis* pv. *citri* strains.

Although previous studies have evaluated the use of phage for the control of citrus canker, no conclusive data confirmed the virulent nature of the phages (Balogh et al., *Plant Disease,* 92:1048-1052, 2008). Only virulent, non-transducing phage should be used to evaluate and implement a sustainable phage biocontrol system. The sensitivity of three Xac field strains (North 40, Block 22, Fort Basinger) obtained from Florida, to two fully characterized virulent phages representative of the Podoviridae (Xfas303) and the Siphoviridae (Xfas103), respectively, was tested. Results indicate that the three Xac strains tested were only sensitive to phage Xfas303 (FIG. 12). Phage Xfas303 was able to form clear plaques on three Xac strains tested. 454 pyrosequencing was performed of the Xfas303 genome and predicted genes were fully annotated. The presence of a single subunit RNA Polymerase (SSRNAP) was found, which is indicative of virulent phages such as T7 and KMV (Dunn et al., *J. Mol. Biol.* 166:477-53521, 1983; Lavigne et al., *Virology* 312:49-59, 2003). Additionally, it was determined that the type IV pili of *Xanthomonas* spp. strain EC-12 is the primary receptor site for the phage Xfas303 by making in-frame deletion mutants of pilA in the bacteria. Both phages Xfas303 and Xfas103 adsorb and form clear plaques on the strain EC-12, but not the ΔpilA derivative, showing results only for plating of phage Xfas303 on EC-12 or EC-12ΔpilA. It was also determined that type IV pili are the primary receptor site for phage Xfas303; thus this phage may have a different secondary receptor site requirement for infection or that phage DNA was restricted. Results indicate that the developed non-Xac dependent procedure may be used to isolate virulent phage for Xac with no loss in efficiency of plating (EOP of 0.75).

Example 20

Evidence for Expression of Type IV pili in Xac

Reports in the literature are conflicting as to the expression and role of type IV pili in the infection process and pathogenesis of Xac (Brunings et al., *Mol. Plant. Pathol.* 4:141-57, 2003; Li et al., *PLoS ONE* 6:e21804, 2011; Yang et al., *Curr. Microbiol.* 48:251-61, 2004). The results presented above indicate that all three Xac strains tested expressed functional type IV pili, as the pili must be retracted to facilitate adsorption and infection of a phage. Using light microscopy studies the three Xac strains were evaluated for twitching motility, an indicator of functional type IV pili. *Pseudomonas aeruginosa* strain PAO1 and *Xanthomonas* ssp. strain EC-12 were used as positive controls and EC-12ΔpilA was used as a negative control. The three Xac strains (North 40, Block 22 and Fort Basinger) were evaluated for twitching motility. The PAO1, EC-12, and three Xac strains exhibited twitching motility, whereas the EC-12ΔpilA did not. Microscopy studies corroborate results obtained with phage sensitivity testing and indicated that three Xac strain have functional type IV pili that act as an adsorption site for phage Xfas303. Results corroborate the observations of others (Brunings et al., *Mol. Plant. Pathol.* 4:141-57, 2003; Li et al., *PLoS ONE* 6:e21804, 2011; Yang et al., *Curr. Microbiol.* 48:251-61, 2004) that type IV pili are expressed by Xac.

SEQUENCE LISTING (24 sequences)

SEQ ID NO: 1 - DNA, 23 bp, Artificial sequence
  Forward primer designed for X. fastidiosa gyr B
gtttgattgatgaacgtggtgag

SEQ ID NO: 2 - DNA, 23 bp, Artificial sequence
  Reverse primer designed for X. fastidiosa gyr B
cattgtttcttggtaggcatcag

SEQ ID NO: 3 - DNA, 20 bp, Artificial sequence
  Forward primer designed for the bacteriophage DNA primase gene
aagaagcgtggtttgtttgc

SEQ ID NO: 4 - DNA, 20 bp, Artificial sequence
  Reverse primer designed for the bacteriophage DNA primase gene
ctaccggcttccctaactcc

SEQ ID NO: 5 - DNA, 18 bp, Artificial sequence
  Primer
aactacctgacagcgact

SEQ ID NO: 6 - DNA, 19 bp, Artificial sequence
  Primer
cgtactagcttggcttcta

SEQ ID NO: 7 - DNA, 18 bp, Artificial sequence
  Primer
aacctgatctggtacgac

SEQ ID NO: 8 - DNA, 20 bp, Artificial sequence
  Primer
ggacatttttcagttctctc

SEQ ID NO: 9 - DNA, 19 bp, Artificial sequence
  Primer
caacctcatctggtatgac

SEQ ID NO: 10 - DNA, 20 bp, Artificial sequence
  Primer
gtcttgggtaatttctttct

SEQ ID NO: 11 - DNA, 56132 bp, Unknown
  Bacteriophage Xfas101
gggcgcagaacggcaagtcgatgaagaagaagaacaagtacggcaagcgcatcaactgcggcttcgacatcatccagcacgtgatgcacgatgatccgctcggcggcgcaatgcgtcccgacgtggacgacgtgctcgacgagctggacgacgatttcgacgacgtggatgtcgacgaggacgaagaggacgaacgccccgcgcgccgttcctccaagaagccgtcgaagtcgagccgtcgttctcgtgacgaggacgaagaggatgaagaggaagaagaggaagagcgtccgcgccgttcctcgtcgaagaagccgtcgaactcccgccgccgttcgcgcgacgaggacgaagacgatgacgacgacatcggcctgtaattcctcgggttgacagtgctacttcggtcgcccggggcttgtccccgggcttccgtttttctgagaccagcgcatgcaaaagcctcaatacgactcgacgctgcaccacgacttcgagaccttcagcgaatgcgacctgaaaaagcacggtctcaaacgctacgccacgcacaggtcgaccgaagtgctgttcctgtggtacgcgttcgacgacgaagagccgcaggtatggttcccgaagacgcagatgatgccgaagcgcctgcgccttgcgttgaagaacccacgtgtcaagaaggccgcgcacaacgcgcagttcgagcgcgccatctggctgcacgtgctggacatcgatattcccgtcgagcagttcgagtgctcgatggcacacgcattctcgctggcgctgcccggcgacctcgatacgctctccaccgtgctgcgcctggacgacaagacggcgaagatgaaggagggcaaggcgctggtgaagttcttctgccagccacgtaagccgaccaagaccaagcagtacacccgcaacaccaagctcaccgatccggtgaagtggcagaagttcctcgactatggccgccgcgacgtgatcgccgagcgcgctgctgcacgcaagatggcccgcttcccgatgagcgcgttcgagcagcgcttgtggactatcgaccagcacatcaacgagcgtggcgtgccgttcgacaaggcatacgtcgaagcggcgctgcgcgtcatctcgaaggagaaggcgcgcctcacgaagatcatgaagcgcatcacgggcctcgaaaacccgactagcggcacgcagctcctaccctggctgcgcgagcgcggctatccgttcaccaatctcaaatccgcctcgatccgcaaggctcgcgaggattgggattggaacatgaccgacgaagcgaacgaagtgctcgcgctgcactccgaggccgcgcgttcgtctgtcaccaagttgcagaagatgctcgacatcgaagtcgacggcatgctgtgctacacgatgcagttcgcaggcgcaggccgcactgcacgctgggctggccgcgcggtgcaggtgcaaaatttgccccgccccctccgagagatggaagagcagtggcagctccttcttttgcgagaagcgatcatggccgaggacatggattgggtccgcatcctcgtgtcgtcgccgatgggcgcaatcgcgtcgtgcatccgcaccgcgatcaaggcaccgaagggcaagatgttcgtcacctgcgatctgtcgtctatcgagtcggtcacgattggctggctggcggattgtcagaagatgatcgaggtgtttcagaagaacctcgaaatctacaaggtgttcgcctcgcgcatgttcggcgtcccctacgagaaggttgagaagtggatgcggcagcaggcgaagcccggcgtgctcggcgcaggtttccgtctctccggcggcggcgaagtgggcgagtacccggaagtcatcaagaccggcctgctgggctacgcagagagcatgggcattgagatgacggcggaggaagcggctgcggtggtagcgttcttccgcagcgagtacgacgaaatcgtgcagctctggtacgacctcgaacgtgctgtcgagaaggtgatgcgcacgaaggagccgcagcgcgtcggcccgattctcatggacgtgaaggggccgttcctgcgcatgcgcctgccgtccggccgctacctgcactacctgcgtccgcagatgtcgtggaaaaagatcaaggtcggcatcgacaagaggaccggcaagccgaagtacaagtcgaagaagggcttcagctacgagggctacggcgggaagagccgcaaggtctggatgcggatcgactcgcacggcggcaagatcgttgagaacttggtgcaggcgattgcacgcgagctgctggctatcggcatcgtgaccgcttgggacaacgggctggacatccgcatgcacgtacacgatgaaatcgtaggcttggtcaaggcgaagctcgcagagattgcagcgcgcgaccttgaagacgacatgaccgtacagccggagtggtggggcgacgaagtgccgatccgcgcgaaggcagaaaccgtggagtgctatcagaaatgagaggcgacatcctatcaaccgacaagcaccgtctcgaaaaagacgtagaagagaagtggtgcaaggtggcgcgcaaggccgggtggaaggcgtacaagttctcttcgcccggcaacagcagcgttcccgaccgcatgttcgtccgcaacggcttcgtgttcttcatcgagttcaagcgccccggcggaaagcctacggcgaaccagatcgaagaacacaaggagctgcgaaagaagggcatggtcgtgctggtgatcgactacttcgacaaagagttcgccgagtgggtgttcgcatgaaggaacgactcgaacgctcgctactggacgactatcaacgcgctgctggcctctttatcgagagtgtcggcagttgtgctttgtgggtcgacatgggcctgggcaagacggtggtcgtgctcacgcacgtgtccgacaaggtgttctccggcgagtggagccgcgtgctggtcgtcgggccgccgctggtggtgtccgacacgtggcctacggaggtcgatagctgggagcacacgcactggctcgactttcaggaactcgacggcacgcctgagcacatgcgcatgcagttggagcggccgtgcgagattgacggcatctcggtgcataagctggatcgtctcgcgtcgctgttcaagaacaacaagaagccggtgccgtgggacgcgattgtgttcgacgaatcgagcatgttccgcaataaggcgtcgaagcgctggaagcacgcggtaaagctcgcgcaccgccccgagactgacgtgatccagctcaccggcacgcctagtccgaacggcctgcatcaagtgtgggcgcagatggcgatcatggacggcggcgagcgtttgttcgcgtcctacagcaagttcctcgcgcacttcttcaacaaggagttcatggggcgcaagatcacgccgaagccgttcgcgctgaagtcgatcaccaagcgcgtcgccgacatcgtgtacacgctgcgggaagaggattacgtcaagctgccgccgctcattcctcgcccggtgccgatcatcctgcctaagaaggtcttggagcagtatcgggagttcgagcgcacgtcggtgctgaagtggggagaggaagaagacccgaacgtccgcgcgctctcggaaggcgcgttgtacggcaagctgcttcagttcgcatgcggccgggtctacaccggagatgatgagaagaccttcatcgacgtgcatgaccgcaagatcgagcgcatgaaggaaatcgtcgagtttagcgacggctcgccgattctcgtggcgcgcacgtggcagcactcgcggctccggctgaaagacgcgttcccgaacatccgctcgctgaagacgaagaaagacatcgacgcctggaatgcgcgtgacatcgaaatcgcagaagtgcatccggcgagcatcggtcacggcgtcaaccttcagcgcggcggcaacaacctgatctggtacgaccacacgccggatttggagctgtacatgcagttgcgaaagcgcctgcaccgccgaggccagcaagcctcacacgtgaacatgatgcacctgaccgcgataggcacgattgaagaagacctgacccgcgagctggtgcgcaaagaagtaacgcaagacgccctgaaagaacccatgcggcgacgtgtcgccgacgtacagagagaactgaaaaatgtccgcagctaaaatcgactacgaagaagagttcttcaacggcatgacgatcccgcgcctcgcgcagttgttccgcctggaccgccgcaccgtcaccgagaagttgcgcccgctgcgtccgaccggcgaccgccgtggcgcgcccacctaccacgtgtcggccgccgcgccgtacctcgtggagcctatcgtcgacatcgccaagtaccttgcggaagtcggccctggcgatttgccgtccgcgttgcaggcgcagtattggaacgcgcagaacagcaagttgaagtacaaggagaacgccggtgacctgtggcgcacgcagcaggtcatggagattttcgtcggcgctttccgctcgctgtcgcagacgttgcgcctgctggcggatcgcgttgaggcacgcaccgacctgacgccggaacagcgcaagatcatcgagcgcgaaatctccgatgtcgcgttgacgacgctgcgccagcgccttgtggaagacttcgagatgtacgcaggcttcaaggacaaggagcagctcgccgacatcaaggtcgacgacatcggactggacgaggatgagtgatatggatgacctgttttcgtctgcacagctttcccagggcgcgcagagcaccttcaacgacctgggcgaactgctgacctacgctgcgaactcggtgctgctcccgcccgagcgtttgaccgtatcgcaggcagcgtcgaagtaccgctacctcgacaacgaaggatcgtacgtcggcccctggctcaatgaagagacgccgtaccttgtcgagccgatggacgtgctcaacagccgcgattttgagtcgtgcatcttcatcggccctgcgcagggcggcaagaccgaaatcatcttgaactggatcgcgtacacggcgcgctgcgacccggccgacttcttcttgatccagaccgcgcgcgacacggcgcgagatttctcgtaccgccgtatcgacaagatgcaccgcgacagccgcgagattggcgcactgctgcgtcccggcaatgacaacgacaacatcttcgacaagttctaccgcaacggcatgatgctcacgctgggctggccgacgatcaaccagctctcgggcaagccggtgccgcgtgttgcgctcaccgactacgaccgcatgccgcaggacatcgagaagaacggcccgccgttcccgctggcccgtaagcgcaccacgacgttcggctcgttcggcatgacgctggccgagtcgtcgccgtcgttcgacgtgaaagacccgaagtggaagccgccgcgcccggactcgcacatgttcccgccgactgacggcattggcggcctgtacaacgaaggcgaccgccgctgcttctactggcagtgcccgcactgcggcgagtggttcgagccgaagttctcgctgctgcgctgggacacgaagaaccccgatccgtttgcggcttccgagtcgaccgtcatggcgtgcccgaagaacggctgcgtgatcgagccgaagcacaagtacgagatgaaccgacgcggcgtgtggcttcgcgatgggcagagtctcgaccgcgacggcaacaagcagggcgtcggcgcgcgttcgcgcactgcgtcgttctggctgaagggaccggccgcgcgcttcatcacgtggcagaagctcgtcgagcgtatgttgcaggcccagcagacgttcgagctgaccgctgaaacgaaggcgctgaaggccacgatcaacaccgaccagggcgaaccgttctggccgttcaacgctaccgactcgaaccgcctgccggaagacctgcaatcgaacgcgatcaagtgggccgagaagaaggtgccgtacggcgctcgcttcctgctcgccaccgtcgacgttcagaagaacatgttcgtcgtgaccgtacacggcatcggcccgagcgagagcggcgcgggctacgacgtgtacatggtggaccgcttcaacatccagaagtcgaagcgcaaggacgacgcaggcgatacgttgtgggtcaagccgtacgcggtgcaggaagattgggacttgattacagagcaggtcgtcgagaaggagtacgagctggaagacggcagcggcttcatgtcgatcaagatgacaggcatcgactccggcggtaagtcaggctccacgacgcgcgcctacaactactggcggtcaatgcgtgatagcgccaagggcaaccgagtgctgctcatcaagggcgagccgaagttcggtgccccgcgcgccgagattgactaccccgactcggatcgaaaggatcgctcggccggtgcgcgcggcgaggtgccggtgctgttcttgaactcgaacgtgctgaaggacacgttgctcggcatgctcgacgcgaagaaggacggcggtgctcgctacttcttcaacaagtggacgccggactatgtgtacgtcgagatgacggtggagttccgcgacgacaagaaccgttggttgaacccaggcaagcgacgcaacgaagcatgggatttggcgtactactgcctcggcctctgcaccattctgaaggtcgagcatttcgattgggacaacccggagagctggtacgacgagtggagtaacaactctcttgtgcgacctgccgatcaggaaaagaggtttgcgtcaagcccgactacggattatggtttcggtcaattcggagccaccctgggatgacgcacaatgaccctcgaacagttgcaagccatgcttgcggaggcacaagcggcctatcacaccgccatgatgggcggcgcggtgacggtcgtggtcgaccagaacggggagcgggttgagtacagccgggccaacccggcatccctgctgaagtacatcgccatgctccaggctcagatcaacgccatgctgggggtcgcagtaatcggcggcccccttcgccctctcttttaaggcggcctagaccatgagccaagacctcgcagtagtacgttctccggagggcgatgccgccttccagcgcacgatgaacgacatgattttcggcggtgccttcgagggcgcgaagaacctcaaccgacagaccgcgttgtggtccgcgccctcgctgccgccggacatggaaatcacgccggacaaagtgcgcatggatgcgcgcacccgcgatctgattcgcaacgacggctacatccagggcgcgctcgacacgagcaaggactccatcgtcggcggccagtaccttttgaacgctcggcccgactggcgctcgctcggcttcgacgaaaagtgggccgaagagttccagctcatcgccgagcgcaagttcatgctgtacgccgagtcgccgatgaactggattgacgcctcgcgcaagaacggcctgacgggtctcgtgcgcatggcgctggcccaggcgttcatggcgggcgagacgctggcgacttcggagtacctgaagggcaacggccgtccgtacaagaccgccatcaacatgatcgacccggatcgcctgtcgaatccgaacgacaatagcgacactgcgttcctgcgccgtggcgtggagattgatcgtttcggtgcagcccaggcgtaccacatccgcgacgctcacccgatggaatcctactacgaccgattcggcgcgaagtggacgcgcgttccggcgttcaagccgtggggccgcccgcaggtcatccacatcgccgacatcctgcgccccggtcagacgcgtggtgtttcgcagatggtggcggtgctgaaagaaatgcgcatgacgaaggtctacaaggacatcgttctgcaaaacgcggtggtcaatgcgacctttgctgcggctatcgagtcggagctgccgcgcgagatggtgttcgcgcagctcggctccggcgacatgacgtggttgcagaagtacatgggcgcgctggccgagtacgtgggttcttccgacaacctcgctatcgacggcgtgcgtatcccgcatttgttcccgggcacgaagctcaacctgcaaaacgccggtcagccgggcggcgtcggcagtgacttcgaggactcgctgctgcggcacatctgcgcggcgctgggcctgagctacgagcagttctcgaaggactactcgaagacgaactactcgtcggctcgtgcgtctatgatcgagacgtggaagttcatgcagtcgcgcaagaagctcatcaccgaccgcttcgcgacgatgatctacatgctgtggctggaagaggaaatcaaccgcccggagaccgatctgccgatgccgaagggtgccgcgcatttctacgagggcatcaatcgcgaggcgtacatcaagtgcgactggatcggcgcatcgcgcggccagatcgacgagctgaaggaaacccaggccgccgtgctgcgcatcgcatcgggcctgtcgacgtacgaagacgagctgggcaagctgggcaaggactatcgcgaagtgttcgagcagcacatgcgcgagcagcgcctcatcgagcagaagaagctcaacttcacgatgtcgaccagcaagccgggcacgcagaaggctactgacagcgccgcgaacgatgacgccaaggcggacacggctaccgaaaccgaaacggagaacgacgatgaatgaattgctggcgatgcgcatgtcgatcatggagggcttcaacggccgcccggccctgatcgcaccgcaggagatggagaatatcgcgacgatgttctcgtcgatgatgcttcagcaggccccgccgaccgccgaacagcgcgcggcggctgaagaggcccaggtggtgctcatggagcgtgccttcgacatctcgttcccgcgcgagcgttccaaggcgtttgccttcagcgacggcctcgccttcatcccgatgcgcggcacgctcgtgcatcgtaacggcgactcgtggtacggcacgcgcggctacgacgacattcgtcgcgagttcgacgctgcgatggccgacccggacgtggcgggcatcgtattcgacatccattccggcggcggcatggtctacggcaacttcgagctggccgatcacatccgcagcaagcgcgccgagaagcccaccctgtcggtcgtcaacgcgggcgcgatgtctggcgcgtattcgctgggcagctcggcgaagaagatggtgtcgaccccctccggcgattccggcagcatcggcgtcgtcaccatgcacgtcgatctgagcaaggcgatggagaagttcggcgtcgccatttcgctgatccactccggcgaacacaaggtcgacggaaacccctatagtccgcttcccgacaacgtgcgcgccgacatgcaggtgcgcctggacgggatgtggcagaagttcatttccgtggttgcagctaatcgcggaatgtccgaacaagcgattcgtgacacgcaggcccgcgtctatggcgcggacgatgcggtcaaggtcggcttggtcgatgcggtcatgtctccgcaagaggcagtcgcttccttccgggccgaagtcttcggctcttccaccagcgaaaacaggagtcccaccatgagcgataccaagaagcccgacgccaccgtcgaagagcagaagaagaccgacgccaccgtcgagcagcagaagaagaccgaagagaaggtcgaccacgctgccaacgagcgcgctcgtatcgaaggcatcaccacctgcgaagaagcgaagggccgcgaaggtctcgccaaccacttcgccttcaagagcagcatgagcgtcgacgaagccaaggccgcactcgctgcgtcgccgaaggcgtcggcctccaccggcaagtccgcgctcgacgcggcgatggaaaagaccggcggcggcgctgacatctccaataacggcggcgacggcgaagacgaaggcgacaagggcgagaaggccgatggcggtctgctcggtgcctacgcccacgccaccggcaacaagagcgtgctgaaggccgtcaagtaaagaacaccgtcgccagcctagacgggaaaaaccggctacctagtccactcacaggagtacatcgcaatgaccaactttggccccatcgctggcgtctcggtcgacaacagcaacgccaatggcaacatccagctcttcgctggtgagtccgacatcgttaccacccaggtgcagctcgtgaccggcgtcgcctacgtcggcggtcaggtgctcggccgcgtcaccgcctccggcctgttcgccaagcacgatccggcggcgaccgatggttcgcagaacgcaacccacatcctcggctacgacgttccgacgccgaccgctggcaagtgggaaggtgcgtactcgggcggcgtgttcaacgtcgatgccctgaccttcaacgctgcctccaacaccgtgcagaagaagatcgcggtcttcgacggcacgaacatcgtggcgcagcgcctgtacggcaaccccgccccgaactccggcccggtctaaccggcgattcacccgcaatacgtttcgcacataactcaactgaaacaggagaagcacgatggatttgtatagcactgcggaactgcgcaaggtgatcgtcgacagccggccgcccgtgcagtatttcctcgaccgtctgtacaaggagcagatcaacttcacgaccgaagaaatcatgttcgacgagctgcgtctcggccgtcgcatggctccgttcgtggctccgaacttgcagggtcgcgtcctgaagcgttccggcttctacaccaagaccttccgtccggcctacgtcaagccgaaggatgcggtcaccccgggccgcatgctgcgtcgcttggccggtgaaggtctgaccggcgacatgaccccgggccagcgctggcaggccactgtggccgcgtaccagctcgatcagcgcaaccagatttaccgccgcttcgagtggatgggcgcgcaggccgcgctgtacggtcaggtcaccgtgtcgggcgaagactacccgagcgtgaccatcgacttcggtcgtgccgccaaccacaccgtcatcctgtcgggcaccgccgcgtggagcgactacgacaacagcaacccggacgacgacctggaagattgggccgcgcgtatccgtgaagctgaaggcttcgtggtcactcgcgtcacgatgggcagcaccgcctggaaggcgttccgcaagcacccggccatcaaggagctgctggaaacccgtcgcggctcgaagtcggaagccgagaccggcccgggcctgggcgagagcgtggagtacaagggccagatcggcgcgttcaacatctacgtgtacagcgatgtgtacgaagacgagaccggcaccatgcagccgatgatggacccgcgcgacgtgctgctggaagctgaaggtggcttcgacggcgtgcgtgccttcggcgcgatcatggatgccgacgccggtttgcaggcgctcgacatcttcccgaagatgtggaagaacccggacccgtccgtgatctacctgctgtcgcagtccgcgccgctcatgatcccgagccgtccgaactgcaccctgcgcgcacgcgtcgtcgcgtaaggccgtttcaccagcaacgcccggttcgccgggccgcgctgtttacaccacccaatcaaccccgcaacaggagatgtagaaatggctgacgacaagaagaccaccaaggctgcggccgctggcaagaagctggtcgctcgcgtggcgctgaagggcgacttcgatgccctggatggcctgggcaccgcgatgcaggaaatccaggcgggccaggagttcaccaccgaagacgccaagttgcagaagcagctcgtcgacaacggctacgccaagtcggcgaaggacgcggcgaaggaagaagacgaggctccggccagctctggctccgccccgccgaaggtcgagacgaccgacaagaacgacggcaagaagcagcagtaatcgcgcctgggcgctaggagacggaacatgggctggcttgaaatcaaacaacgcgcgcgtgatgtgacgcacaagacgttcggtatcccagccctgttccgttcggcgggcggcgtgtctacggacacgtccgctcgtttgcactacaaggtgcgcacgtacggcgacctcgaccgcgaaggcttcgcgacgaccgtcgacgatgtggactacgttgtgatcgacactcgcgagctgctggcaaacggcatcgtcgcagaagagggcaaccggattaatttcccgcagctcaacaggactttcaaactcgacgtggagcatccttccgaggacagtcgctacgtcaagtgggcagtaacggagaccgctccatgaccatcggcctgaccatcaacggactcgacgacgtgcgcaagatggtgagcggcataccggaaacggtcgaccgcgcatcggctgttgcgatcaacgaagcgatcacgttcggtcaggccgagagcagccgtcgcattcgcgagcaggttgcgttcaaggcgagctacatcggcaacgcgaccgatccgggcgcgagactgcgtgtagcgaagaaggcccgcgtaggcgacctcgtaggcgtcatctccggtcgtcaccggccgacctctctggctcagttcgagcagggcgcgaagctcggcaaaggcggctacgttcgagtcaaggtttccgcgaccggcggatcgaagcgcatccccggcgcatttccgatcaagctgcggcgcggcaacggcgtgtacgacgccgagaactcgaacgaaggtattgcggtgcggctcaacaagcagggagagctgcccggcggcttgaacaagaagcaggcggtcaacgtgagcggaagcctctacctgttgtatggtccgtccgtcgatcaagtatttcgtgatgttcggttcgatgtgcaaggcccggtgggtgacgcactcgaatcgagcttcctccgcaacttcgggagattgaaccgtggctgatacgaagcgactgttgctggtcaagacgctctgcgattacctgaagagcgaaatcaccctggcgaacggctacaacttcgacctcgcgatggttcgtcgtgacaagcgcaacttcggcaaggagatgaagctgccgggcgtggcggtgctggaaaacttcaaccccgaccgcttgccggaaactatcggcgggttcgtcgggcagaagcacaagtacgatcagatttacctgctcaacggctgggctgacaactcaggactggccgagggcgacgatgagacggatgcggcacatctgctcatgggcgacgtaaaaaaggcgctggggaagttgattaccccgcgcaaccaagacgggttcttcggtggtctcgcaaacacgctgtccatcgaacccggggttgttcggcctcccgacgagcaatccgacaaagcgtacttctggatgagggtccgaatggaactcgtcgagaaggtgggagacccgtactggattcgtgattaacccctgcaacaccacccgaaggagaccacaatgggcagcgagaattacacccttggccgtggcgaactgcgtttcgacaagttcgtaccgggcacccgcaacaagaccggcgagcgttacctgggcaacaccccggaactgaacctcaccaccgagagcgaaaacctcgatcacttcaacagtgaccggggcattcgcacgaaggacaagagcatcgttctggaaaagaccgacagcggcaccttcatcgccgacgaaatcagcgatgacaacgtggccctgtggttcctgggcgacgtgagcgtcgtggcgcaggcggccctcaccgcgcaggtccaggtggttccggccaaccgcgtcaagccgggcacctacatccagatcggcgagtcgctggcgaacccgaccggcgtgcgcaacgtgaccatcaccagcgtcaccgatggcgcgggcacccccgtcccgtacacgctcaacgaggactacaccgtcgactccgagctgggccagctctacgtggtcccgggcggcgctatcgacggcaccgaggcgttcaccatcaactacagcgcggccgcctcgacccgctcgcaggtcgtggtcggcgacggcaccaccgtggaaggcgcgctgcgcttcgtctcctacaacccgaccggcccgcgccgcgactacctgtggccctacgtgcagctccgcgcggacggcgatctggccctgaagggcgacgaatggcagcagctcagcttcgcgttcgacatcctgaagctggacggctacgctaccgtctacatcgacggccgtccccaggtggcgtaaccggggcgcgtcaaacgcggtcaaggccaacttagtcaagaccaagaaggccaagaccaacttcgacaggccgctctccgaaagggggcggcctgttttcttgccagcaaccgaggaagccaatgtccctttcgtcccttcgccttcgcaccatcaccgtcccgtacctgggcgcggatgacgagcagcagagcatcgtgctgttcggcctcaacgccaacgacgtggccggaatcatcatcgcgcagaaagacaacatggaagaaatcttcgacatcgttgaaggtgccggtgtcaagaaagccaccgacctcgctgaagtcgacatgatgcagatcggccagaagctcatggtgcagatgccggacttcatcgcacgcgttatcgcgtacgccgcgcacgagccggaagcgtggatggtcgccatgcagctcgacgcgccgacgcagatcaagtgcatgcgcgccatcgccgaacttaccttcaaggacgaggccggattccgcgagttcctgggaaacgtccaagcggcacttcgcggagcaaaaagcgtggtgccgcacctgcgaaacaaaaatctcgaatcgagcgattcgcagggtggtggctcggaatccgagcagcagtctccttcctgaccgctgaaggacacgctctcgcaggcgagtatccgctgggtgtgttgatcgtagaaacggaactcgcgcgcgagcgtgtcaacaaccgcattagaactgaagcggttttgattcaaagcgcaatcggctccgcgctcagcaagaagggcgcgcaggcattcaaggaacaaatctcggagctataggcgatggccgctcagaacgaagttgaactgatcgtacgtgcgaagaacctcagtacgaaaaccatttctcagctcaatgacgagctgggcaaagtcgccgaaaaccaaaacgaagtagccgatgcgaaccgtctcgccgagcggtcgttcgagagtctgaagggcgagcagcagaagttgctcgctatcatgaagtcgctcaacgaccgctcgcgcaagctggaaggctacgctcagcaagagcagcaggtgcgcagcctccgcgaagaactcgcgcgtgctcgcgaaaacctcaacacgctcgcgcagcagtattacaacaccgagaagccgacgaaggagttcacccagcagttgaaggccgctggcagtgaagtcactcgcctggacgcgtcgctgcggaataacgagcgccgcctggaaacgtcgggcgcgaagctgaaggagatgggcgtcgacacgacccgcttcagccagtcgcagcaggaactcaacagtgcggtcaacaactcgctggcgctgtaccggcagtcgaccgacaacatggagcgctacgacaccgctgtccgcgaagtgcggcagcagcaggaactcgcgcagcaggaagaacggcagcaggcgcaggccgcccgcgattcggccgctgctgttgcccaggccgcgaaggaccgcgaagagcaggcccggaaggagcagcgcttcgtcgagctgaccaccaacgtctaccgcaccctggcccgcgagaaggagaaggcggcggccgccggggcgaacttccgcgccaccggcacgcaggctgcgcaggcggcccgcgctaccgccgcccctgccgtgggtagcgggtcgaccctgggcggggcagcagcgggcgtacaggcggtgctggaaccggccaagcaggcggtcgctacgctcgaccagctcgaaaaggccgtcgaccagctcgacaaggagttcgaggccctgacgccggacgccctgaaggccgctgacggcatcgagaagctggccgaccagagccgccgcctgcgggaagcggccgccgcgctgaagggccaaggcggtctcgccgatgacctcgcgcggcagaacacggccttgaccgccagccagcagcggttcgaggaagcgcgccaggaagtgctgcgctacgccgaagccgtggagcgatcggatcgcccgaacgacgagctggcggcgtcgctgcaacgcgcacaggccgcactgcggcaggcccaggcagacctgggtcgacagaccgaagcgttcaaccgcgtgcagcagcgtgcggcggccgcaggcatcaccctggaaaacctcaacggcatcgagcagcgcctcgctcagaacgccactcgcgttgcgaacggccagaagcaggtcgcgcagacgatgacgcagttggagcagtcgaccgcgaagaccagcaagcagctcaacgcgctcaacaccgggcagcgcaccgcgctgtcgctgtatcagcgtacccgtggtcaggtgctctcgctggtgtctgcctacgtgggcgtgttcggcgcgatcaatctggtgaaccaaagcgtcgacgccgccgtggatcgcgagcgcgcaatgtcgcgtctcatgatcgcaaacaagggcgacgccaacgcggcggcgaaggaatacgactatctgcgcaagaaggctgacgagctgggcctcgccttcggcccgttggcggattcgtacagccggttctcggttgctgcgcgcgatgccggtatgtcggcggaagcaacgcgttatatcttcgagtcgttcacggaagcggcgacggtcctgcgcctgagtggcgaagagactgagggcgcgttccgcgccttggagcagattttctcgaagggctacatccaggcagaagagcttcgcggccagctcggcgaccgcatgaccggcgcgttcaatttgttcgcgaaggctatcggcgtgtcgacgcaagagctgaataagatgctcgaaaagggcggcgaggttaaggcggagttcgtgctgctggcggcgcaaactgcgcgcggtatttatggtccgcaggccaaggccgcatcgaacagcttgctcggcgacattaaccgcatgtcgaacgcgtggggcgatctgaagcgtgaaatcatcgacggcggcctcggtactgcgctgcgcagcctgttcgtcgatctgacgaagttcctgaagagcgacgacggtaagaagttcgctgcgaatctgacgaaggtcttcgtcgcggccgctgaagcgggcaaggagctgatcgacgtattcgccgagtacgacggcctgatcgagaccgtagcgaacaccgtcgccttcctcgtgcggaacttcaaggagctgatcgcgatcatgctggcgatccaggcagcgcgcatcgccatcgtcttcactcagctcgctacggaaatcctgaaggcccgtgcagccacggtcgcgctcaacacggcgctcggtgcgggcacggccgcgtctgccggtcgcgcaggcgcttcgctgctggcgctgatcggcggccccatcgcggcgctgctggcaatcgcttcggcgggcgtcatcatcccgatctatttccagatgaagggcgagctgaagtcgaacaacgacaagctcgatgtgcagaagaccgtcacggaactcaaccgtggttttgcggcgtccgagcgaaacctcgcagttctgtcgcgcgacaacaccgagcagttggaaaagcgcgtgcaggcagcgcagcgcttgctcacgatctacgatgagcagaagaagaacctcgccgatcagatcgcgcagaacacgaccatccgcaagaatcaggtcgcgattcgcactgcgcagagcactcgggaaggcgacgccaatctgccgtcgaagcagttcgaggctatccggcaggtcgaggccgagggcaaggcgatggaggcgcagctcgccaacctcgaacgccgtgcggccccgctgcgcgagctggtcgcatcggccagccgtgacctcggcatcgcgaagtcgaaggcggccgcgaccgagaacgatgcgctgtcggccgagttcaagcgcatccaggccgaggcggacgcagcggcaaagcgtgcgggcacggacaccaaggcagcgaaggcggccgaagcggcgcgcaagaagaaggaggccgaagagaagcgcctcgccgccctggccgagcgccgtgtgcgcctggaagaagacgtggccgagaagctgcgcgacatcgacagcgacatcgcccaggcgcgcccggatacgctggaagaccggctgaaggtgatcgacaacaagatcgctgatcgcaaggcagagttggagcgcatgatccgcgaggcggaaaagctaaacgtgcccgatgcgaagaaggaagcgcagcgcggcctggacgcactgccggacctcgaaaagcagcagaagcagttggccgagcaggagttctacgaggctcgcatcaacaccctgttgcagcagcgcagcacgtccatcgacacgatcaacaccttgcaggaagccggtctgctgacggcaagcgaagcgtccgcgcagatggaagaggtcaacgctcgtctgctgccgcagctcgaagctctgcgactgaaggcggtcgagttcatggctacgctgggcgatggcccacaggcccaggctgctcgcgcgaacctcgaaaacctcaatgcgcagatcaaggcgatgtcggtcgagatgtcggcgactaagcggaagatcgtcgacgtgttcaccaacggcttcacgaacgccttcatggagagcgcggcggtgatgtccgactacctgaagggcatccagagtgcgggcgacgcatggaagagcttcggcgacatcgtgctcaacaccatcgccgacattctcgtgcagctcgcgcagatgattatccagcaggccatcttcaacgcgctgaagcaggcttcggagagcgcgagcggcggctggggcgcgatcatcaacgcggcgatgagctacgtgaagcatgacggcggtgtggtcggcgcggcgtcgaagaagcgtgcggtgccgagctacgtctacgagagcgcggtgcgctaccacacgggcggcgtggcgggcttcgcggccgacgaagtaccggcggtgctgaagaagaacgaagaggtcttgaccgaaaacgatccgcgccaccgcttcaacggcggcatggctggcggcagcggcccggccccggtagacctgtctatcatcaacaccatcgacagcgagagcgtggttgcggccggtgctaacacccgcgctggtcgtcaggcgatcttcaacgtcatcaaggctgaccgagcctccttcaagaaactcctgggcaattaaaggaaccaacatgggacacgcaatcggaactgttacgggcggcagcggcgacgaggcgtactacaaggtactcgctgcgatcaagaccctggctgaagcgaacggatggacgacgctgcgctacgtcaacacaggcacgaaccgcgagctgattttgaactcgaagggcttgtcgggaacggaggacatctacatcggcttccgtacctacttcagcacgagcggcgactactacaatatcctcgtgggcgtgttcaccggcttcgtatcggctaacacgttcgacgctcagccgggcgcgcggctttctggcgtgccgtgccataacaacgccgtcacctacttcatcactgccaacgcccagcgcatcgccggttgcttcaaagtcggcacgccggtctacacgcacttctatgcaggcaagatgttcccgtattcccgccccggcgagttcccctcgccgctggtgtgcgcgggcatgttcgacggcgcagcggcgaagcgattctcggacctcgactacgcgttcccgtatcacggtcgtgagagcggcgcgtcttccccggagcgtccttcgctgctgtggctgcgcgatcaggtaggcacgtggcgtcgcctctcgcatttcccgttctataacggcgcggctggctcgaactcgtggaacggctacaacgcgttggcgaactacagctacttggacacggacgtaagccaccgctccctggtcccggcaggaacgaactaccagccgcagccgatcatcctgtacaccaccacggccagcggcgacacctacgcgggaaatgtcttcggcgagctggacggcgtgtaccagatttccggcttcaacaacaacgtggagaacgtggtgcaggtcggcggcactgcggtggacagcaccggcatgaccgtggctgagcacgtcgatgcagtccttgcggcgggcggccgcgcattcgtgatgctgcaagacgtgggtcgaaccgactggcgcagcttcatcggcttggagatgacctaatgttctacaccggcaatttttcttcgttcgtgacgctgaaggcgtcgatggaagcggcgcttcagaaccacggctgggcgctcaacggcgacggcacgctggaaaagaacggcatgtacgtccgcctcgtggcgaccgacatctaccagatcgcagcgttcgcaggcaccggcagcgccgtcgacccgttccctctgccgggcgcggctccgtacggcgtgaaaatcatgaacttcagcggctcgccgatgaacttcccggcgacctatgacctgcacgtgttcgaggaaaccgatgaggtctacctcgtcatcaattacaacggcgacaagtaccagcagttgtcgttcggcaagtctcgcgtcgatcaggtcggcggcaccggcatgtggctcaccggttcgttccgcagtgacgtggtgcaggcggcaacccatctcgtgtacaccaacgcgtcggatagctacgtcggcttcgggtggagcggcatggggtgtggcttgttccacgaggtatacaacgcgcccctgggctgctcctacatccacactggcctggactcaaccgggtggaagcgcgtagggaccagcgaaggtgatttgatgggcagcggcgatccagttgccgctctgctgcaatcgctgccgtcgcagttcaaccagagcaccgtgctcctgccgttgctcgcggtgcagcgtcgtctctcgaaggggcagactatcgccgcagacctgcaaaacgcgcgcctgtgtcgcaacgacaaccacctgtccggcgaaatcgtgacctacggcaccgaccgctggaaggtgtacccgttccaccgtaagaacgcagcagtgcgcaacggcgtgccgtggtcgaccggcgcggatcacagcggcacgtttgcctacgccattcgctacacggggccgtgacatggcagcacgtatcggacaaatggggagcgcgtttgagcggggcatcgacaacccgatgctcagtgatgacctcaacaaactgactgaagtcgtgtcgatgttcgacagctacgacggcggtcgcttcttgcagggccgctacggtagctggcacgtgcattcgagcaaccaccggggtgtgtcggcgcagcgcaagatgacgagcttcttcgacgactactacaaccgcatcttcatcgtcccggccgccctggatgcgggcaatctgctgtccacgcaggtccggcacatcatcctttggaatgcctacgtcacgccgcagacgttggagtcggccgtgctcggcccgcaggcaggcatttcgatgtctcccccggcgggcgtcagcattccgttcgagatgccgccgctgcgtgagctggatttcaccgttcagatcgaactggcaggcccgccgacgatcagcagctatgcgcgcttcaccgtggaaggcgtcaactacaccgtgccgatcaccggccgccgcatcgttctcttcccgttctctccgaattgggggtctccggtcgacgagacgatcacgcatcgctcgtgggtgctgtcgtcggacgacggtagcgagcagaccggtagcgagtcgggtgaagtgccgcgacgcacgttggagttcaacatcaatctgcggacttctaagcaggcccagcgcgccgagaatctgctgttcgcatggcaggcccgcttcttcggcgtcccgcattggggcgaagagtcgcgtaccgacgcagccgtcgaagcgggctcgctcgttatccccttcaacaccttcggcctgtcgctcgaacccggttcgctggtggcgctgtatctcgacgacgaggtgaacgaaatccgcgaagtgcagcaggtcactgctgacggcgtttcggtcacgaccgggttggagtacgactggcctgccgactcgcgcgtgtatccgtgtttcgttggcctcatgagcgaagagatgtccgagcagcgcgagacttcccgcgttggccgcatggcgatgtcgttcgacttcgagccgagcgtaacgccgggcaacgcggcgatgaacccggacccgatgacctaccgagggcacgagctgtacatcaaggagaccaactggctgtcggcgatgcctttctccttcagcgcggacacgaagcgcgtagacaccggcacaggcaagttcgttgccttcaccacctcgggcttctcgaaaatcagccgccgccataactggacgctgttcgaccgcgctgacattttcgagttccgtcgtttcctcggccgtcgccagggtgttgctcgttcggtctacatgccgagcggcaccgaagatttcacgatggcggcgacgatcctcgacaccgagaactcgctcgtggtggagtcgaacgaatacgcgaagctggtcggtgcgcatcctgctcgccgcgacatcttcatcctgttgaagaatggtcggtatttctgtcgtcgcattacgctggttagcgagttcgacaacctgacccggttgcagctcgacagtgcgctcggcgaagaggtgcggccgcaggatattcgtcggatcagttttttgacgctgtaccgcttccagtctccttccaccacggtgcgctacctgaccgattccaaggccaccgtcgagtcgatgctggtcgccaagatgaccgaggactgatatgtctctggcccaatacgaaagcagcaaagaacaaggctctcgcgtggagctttacctgtttgagagcgacgacggccgttaccgctgggcgtacaccaccgatgcgcgggagcgctcgattggcccgattacttacaggcccgaagcgattaaacgcggcgagctgaagcagaccgcaggcgatgccaacgtcgagagcctggaagtcgtcgtgccgttcgacaaccccgtggcggccgcgcacgtgccgtatctgccgcctcgccctatcaagctgacgatctacgcgtaccagcgcaatgaccccggcgcggaaatcgtgcaggcgttcaccggcttcgtgacgagcttcagccagaagggagctgacgcgacgctgcaatgctcgcagatcatcgacaacctttcgcagacggtgccgtgggtggtgttcaaggtcggttgcgtgtgggcgctgtaccagatcggttgcggcgtcgacaagtcgctgtggcggcgtgatgcgctcatcaccaccgtggacggctacacgctcggctcgcctgagttcgcgtccaagccgaccggctactacaccaacggcttcatcgtcgaccgcgagaccggcgagcagcgtttcatcacggcgcatgacgcagccaccgccacgatcaaggtcgtgtatccgttccaaacggtgcagggcgggcagattctcgacgtgtacgcaggctgcgcacgcacgaaggaagtctgctcgggcaagttcaataacaagatcaactacgtcgggttcgatcacttcccgacctacaacgtcttccagcaggggatcacctaatggcctggatcgcaattatcgtcgcaatcgtcgtcgcaatcgtcggcgagctgctgcggccgaagcagaagttcaacgacccgaacccatcggccgtgggcgacttcaagttccccaccgtggacgcctcgcgcgtcgtaccggtgtggtggggcacctgcaagatgatggggccgaatgtggtgtggttcggcgacctcgaagtcgtgacgctgaagaagaaggtcaagaccggctggttctcgtcgaagaagatcgtcaccgggtacaactactacctgggcgtgcagctcgtgttcggctacggcccggcagacgagttcatcgaactgcgcgtagacgacaaggtggctgaccttgtgcgctcggtgttcaagtacaaggacacgtggctggccggtcaggtcgcgagcaaggagttcgtcggcgacaagtgcgagttctacatctgctcgccgtccattctcgacaacggcgacccgccgagcggcgtagttggcaagtgcgttctgtaccaaggcacgttcacgcagggcacgaacaactacctctccggccagtggaacgaaccggacatgtccgcgttccgcccgttggtgcatatggtcatggagaagtgctacctcggcaacagcgacacgccgccgcccatctcgatcattgctcgccgctgcccgaaccagctcggcctgaccggcggccgccacaacgtcaacggcgacgcgaatatcgcgtgcgcgtcgtatgagttgatgaccaacaacatgtggggcatgaaaatccctgaagacaagatcgacgttgactcgttccgcgcttgcggcaacctgctggctgaagagtcgctgggcatttcgatgctggtgcagtcggccatgctcggcaaagacctcctggccgaagtgctgcgccacgctgacgccgtggtgtacgccgatccggtcaccggcctgtacacgatgacgctggcccgtgagttctcgcaggccgagaaggacgacctgctggttattgacgacagcaatatcctcgaagacagcttcgacttctcgcgcacgtcctgggagatgacgaagaatacgatcatcgttgagtacaccgaccgcgcctcgttcgagaccaagccggtgcagtaccaagacctcgccaacatcgacgtgcgcggcggcatgatcgacgcggagaccttcagctacctcggcttcagcaatgacactgcggcgatgaacaccgctgctcgcgtgtcgaaaatgaaagcgtcgccgctggtctcggcgaagatgtcgctcaaccgcatcggctacaagctgcgtcccggctccggcttctggctgcgcaagccggatcgcggactggcgaacgtgctcatgcgcgtgatcgaaatcagctacggcaccctggacgacccggcgatcaagatcaccgcgatggaggacatcttcgaggtcaacgctgtagcgtacgtgccgccgggtccgggtgattgggttccgccggttactgctctcgcaccgttcgctgcgcagcgcgtgatcgaagccccggcattcggcgctgacgatatgagccgacgctttctcatcacgatgggcgtgcccgcgagcaacggcgtcatcggctacgacgtgtggagcgaccccagcggcgcgtcgaattaccagatcaccaacgtggtcgagggctacacgccgtctgctgttctcttggccggtctgtcgcgcactggcccggaagtcgacaccgcaggcttcaccgtgtcgtcggccatcgggctgaccggtcttgacccaggcaccgatggttcgcgagaggcaggcgagaacctgctgctggtcggcaacgaactcatggcatggaagaacatcgtcgacaacggcaacggcacgttcacgatcaccggggtgtaccgcgctgtgctcgacaccatcccgcaggatcacgctaccggcgcacgcgtgttcttcctgtccgaaggtgcgggcacgaccaacgtcgacggctactcgggcaacgtcacggtcaacacgaagctagctccgaagaacgtgtcgtcgtcgctcgacatcaacctcgcagcagccgtcacggtcacgaccaactcgcgctctctgcggccgctgccgccgggccgaatccgggtcaacgccgcgccggtcggtgctggatcggccttcaccggggacatgatcttgacctgggcgcaccgcaaccgcctggacgggactatcgcctcccaggccgatccgtcacgtacgccggaggaagggacgacctacaacatccgggtctacaccggctcgaacgccctactggcagaagcgcttgcggtctccgacgctgctaccgccgcgaccatccgcctcgcagtagcaggagacatgcgcatcgaaatcgagtcgatgcgggagggcctggcctcgtggtcgaagcaggtggcctacttcagctacactccggccagcggcacgatcacgaacaccatcgcggtcgacgagccggagtacgttcttgacggaggcggcgcgtaatggcccaggtagttgttgcccaacgcatgtggcagcgccgcgacgtagcggcgaactggcaatcgaagaacccggtcctcgcggccggggaaatcggcgtgcagctcggtgcgacttcggacgagaccaagttcaagatcggcgacggcgtgacgccctggaacagcatcggtttcttcgaggggcggctgatcgaaatcggtacgggcggcggctacatccgctggcgctacgtcggtgacgagaactggatcaacctcgtgtcgctcgaatccctgcgcggcccgcaaggcaacgcaggcgcaaccggcgcgaacggcctgagcgcgtatcaggtggcggtggcgaacggattcgccggtacgcaagctgagtggctggcgtcgttgaaaggcgcgaagggtgaccccggtatccaggggccgcccggcatcccatcgcagcgtcgcatccagagaatcactgacaccaccagcggctcggtcatctgcgactggaactcgtacgacgaaatccgagtgacgctcacggccaacacgcagatcaacatggaaggtgctctggacggccagggttgcgttctgttgctgaagcaagacgctgttggcggccgtgcggttaccttcagcaacaatgttcgattcaacaacctcatctcgacctacaacgccacttccacgccgggaaagtctgaccgcatcggtttcgtgtacgacgatgacgacggcttctacgatgtgcaggccgtggtggatggaatctgacgatggccgacgaatacaccccgccgctatcgcccaacatcgtttgggtgttcaagggcaacgagtacaacccgccgctgtcgcccaacatcgagtggattttcggtgctgacgatgacggaggtggcaacgagttgcgcaagtcttcctacatgcttctcttgactatgtgaggttctgaaatgactgttcgagtttattcctcttctgacgcagacgctccggtccttcgcggcaatacgcccggcgacctcatcaacgtgctcgaaaagtgcctcgtcaccggctacggcagcaaggcgggcgcgggctggacgaagccgttcgctggcaccaacgtggccgcattcaagcaaggccctggctccaatggcatgtacctgcgcgtggacgacaccagcaccgccaccagctaccgtaaggcgaaggtcgtcggctacgaggtcatgaccgatgtcaacaccggctcgccgtcgcccttcccgactctcgcgcagaacccgcagggcggcaattggttcacccactacagtagcggctcggtggcgaacccccgcccgtggacgattatcgcagacgagatgttcttctggttgttgctgaccacttacccggagagcggcacgcagtattaccgcgagtgctacgcgttcggcgacatcatcccgttcaagccgggcgacaccacgcacaccatcctgttgcagaacgactcgcccgacagccccaactcttcggagcagtatccgttccagggttacagcatttcttcggcgatgaaccgctaccgcctttcggttgcgcgtgacttcaccaacctgggcggcccgatcacgctcggctggcacaacgatatgaccaagggcaacagcagttggggcaacggtaacctcagctatcctcacggccctgacggcgggctgtacctctctccggtgtgggcgcacaacccgaatgtcggaccctacagtattcgcgggatcatgcccggcatttgggttcactgccactacttcggaatcctgcccgatggcgcgttggtcgaaggccagggcgaactggcagggaaacagttcctccatcgggtgcactaccagaactccgcgttgtttgaaatctccgacacctgggatcggtaaactgaaatgctgctcgccaacctacccctaagctcgccggaaggatcgacttcgtacgcagacgctacaggtcgattttggagcggctacagcgtcgctccgatcatcatcgacggagcggcgcgttttataggcgacggtctgatctacacgaacagcggcggcgatttcctgctcggcacgaaagatttcgacatcgctttcgacatccagactacgagcagtacgctctccaccgttctagactacctgaccggcagcggaagcacgtggcaggtgtatttcagcaccgaggggcgtttgatctggacggcggaaggccccaacgaatcgccggtaatcggtacgacgagcgcggttaacgatggcaactggcacaccgtgctgttccgtcgaagggacggtgtgctgagcgttttggtggacggcgcagtggaagcgtcggtgcctcacgcccgcaactacaactacgcggtcagcacgtttgcaatcggcggtcgtttgtacttgggcttctcgtatattttcaggggcggcattcgcaacgtctacatcaacgtcatcgacccgccgcctgcacccgcacgcctcgccgcgttcattcgccgcagccgcatcggctgggacaaagtaaccaaggttgattcggtcaagaagatcgaggtctatcgcgcgcctccggccagtttgcggaaggtgcagaccaccaagtcgacgcgaggtgtcccgccatggtggggcgctccggggtcgaccaacgtgctgccgacgtacaagctgcgcggccgcgtgatgcagcgagacccggatacgcaagaagacacgccgttgcagaacgtgcgcgtcgctttgttctaccgccgcctgcatacgctgatcgacatccagctctcggatgcgaacggctacgtgcagttcaacaacctcatgcccggcgtccaggcgtactacggaatcgccttcgactcggacggcggcatcatgcagaactcggtactgtgggatcgcctcacgtccgaacccggcccttaattaatcaggagaagcaccatgaccgactcgaagaagctcaccgacgctgacatcgcacgcgcagccaaggcccttgttgtatcccaggcgaaggtgcgcgccattctcgatgtcgaagcgccacgcggcgggtttcaggacgacgggcaggtcacgatcctgttcgagccgcacaagttctcggagtacacgggcggccgcttcgacaagagccacccgcacctgagcaatccggtgtggggcgcggttccctacagcagctacgccagccagcacggcaaactgcaacaggccgtggcgctcgaccgcgacgccgcactgcgcgcaacgagctggggcatcccgcaaatcctgggcaacaactggaagaaagtcggagcggcatcgttgcaggatttcatcaaccgcatgttccgcagcgagggcgcgcagctcgacctcatggtggcgttcatccagagtgacaccgagttgtggaatgctttgaagcgcggcgattgggccaccgtcgcgagaaagtacaacggctcgcagtaccgcaagaaccaatacgacgtgaaacttgcagcagcccatagaaaattcggaggaaactgagatggaaatcaaaccgcgaatcggtgccgacttgtggcacgccatcacccaaggcacgacgctgaaggtgcgtttcattctcgccctgcaaagcctcatcttcggcgcgagtttgctggtccggcccatgcccgccccgacccggtgggcgctgttcgccacgctgccggtctacgcatggtcggcaatgctatggctcagcgggtcgctcatgctgtggcgcgtgctctccacgcggccggtgacgtggctggcttgggcctccaacgtgttcgcgctgttcacttggtttatcatctgcctgtcctatgccgccttcgagggctggcggggcttggttggcacgcacatcctggccctggtcatggctgttttctgcgtgctccgtactgaggcgactcgtagcgatctggaaacagcgtgatggacgttgagctggaagctgcggtcgacaacatgacaggggaattgacggtggatgaaacgaacgcctggaagtgggtggcggcactgctaggaacgctggtgaccggcggcgtcggttgggtcatcaagaggcagcgctcgggccagattctcgacgacaccgagaacgcggccaagactgatttgatcgagcggttgcagaagcggaaccgggagctggaagaacaactcggtgagcttttcaacaaaaccgccgccgggtacaacgaaatcggcgaagccaagcgcgcggccaacatggcgagcatcgaagctgacactgcaaaagccgctgccgcacgcgcatcggaagcagcgtcccacgcgcaaaggatggcgcaggcggccgacgacgtttcagcgaaacgactggtctacatccacgagctgcgtgcgttgctcgtcgccaacaacatcccgttgcccgcgtggccggagggggttctatgagctggttgttgaacacgaggctgggccaggggttgatcctggccgtggtgattctgctctgctggtggggcttcgcctcgcactacgaacagaaggggcgtgacgcatgcaaggccgagggcaacacgcagtacatcaagaccgaggcgaagggccgcgacgtggcccagcaggcggacaaggaagccgcggcggtcgagcagcaggccggacagacgaaggtcgagaccgtcgagaccatccgaaccgtctaccgcgaccggatcgtcaccaagccggtcagccccggtagctgcgtccacccggtcgacccggcggtgcaggccgagctgctggcccgctggaaggacgcgaacgggggtgtgccatgaccgcccgcgccctggtgctggcggccgccctggtggccctgtgcggctgcacgcaggccgttcgcccggcaccgcctaccgtggactgccgacaggccgcctcgacgcccctggaccccctaccggcggctgacgagtgggtggagtgggtgccgcccacccccgaacggcccaacggcctcgcccggctgtccgcacgggccgccgagtgggttgccagtacgctggtagcggtgaagcgggaacgcgccctggcggccgtgcaggagcgttgcctggacgggtacgagaaggcgggggcgatccgccggtagttgacagccccggcggtcggggatagctttagggccgctggtcgcacttcgcgttgcatcggcacctcggtagggaacgcaggaagagaatcggcgctcagcctgcaactggaaaccccggactaaacacccggggttttcttttgcggtcaaggccaagttggtcttgccccggttggtcttgaccgcaaaagaaaggccccgttgctgagacggggccttccgggggtggcgcgactctcgtcggtggccgggtgtcgactgcgtggttctgctgattccggttttcgctatgcgctggtccggctggaagggcaatatcgcttcgacgactcgaccataaggccgcgtgggtcagcgtgtcaagcgtccgtcgatcacctgttccaacttgccgcccaggtgttgcagcgcctccaccatctcgcgccactcgaacatgtgccgcgtgcggaacgtaccgaacgcatacaccgtgatgccgtcccagcggcggccccggatgtcgttgaggctcgctacccgcttccactcgccgcgcgatgcgcctttgatgtcggcgcactgttcggcctgtctgtcgtctccggcgatgatgtagatcatggcttaccccttgaacttctcgacgtgcttcagcattttctcgcgcgtctccttcagtccatcgtcccacgtcttccaagccgccgcgtcgatgtggctcaggatttcgtcgcgggccatgttgctcagcacggtgggcggcagagcgtccagctcccagctcgattcgccaaatcgcttgcggtaattcacgaaacgcgagtccgtggtttttgccgggttcggcggcggcttcaactcttcgatctggtcgtagttcaacgccatgcgcttcaactcgaactcgccgcccaggccgaacaactggaagcgttcgatcaggtcgcgcgtcatgtcgatgccgctcgggtcgtggtcgccgaagtgcaggatcagcacgtccttgtcggcgttgtgttcgatttcccgccgcgcgaaatcacgcacaaccgatgcgctcgggtagccgcgcgccgcgagcagcggcacatcgtaattccagcacacgttttggaacacgccgaccagtgcttccttctcgactacaaggaaaatgcggcggtcctgcgcggcccacgggtcggtgtggtactgcttggcgctggccgtcaggatgtccttcgggttattccaacgcccgcgcgcctcgaacgaacgcgtgcggtcttcgatggcgtcccaatcaaccagaccggcgatgcggccatcgttgacgaggcgggtgatgtacttataggacttctcgttgttcggaatgatgtcgcgggcaacgagctggtagtaaagctggcgcactgtcagcgtgtagccttcgtcctgatagacctcaatgatgccgttgatgcggtcgatcatttcgaggctcttcttcttgaacgtgatttcctgatacatctcgcgcatggcactcggctccggttgttacagcatgatgctcatggaatcgttgaaggtgatcgtgcgctcgtcatcggcacagcgcgtctcttccttcttgatgttcagcgtttcgctgccccgcacgcacacgaagccgtccttagtgacgttgcagaacccggcgctgtggacttcgacctcgacgttggccggtcgaagctcgatggtgacgtgccgcttcatcgccttggcgatttccgagtgggtcaggtgctcggagaagatgaaggggaacgccttgctcacgtccatgtcggcgaacgtggccttcaggatgacgtacttcatacgccgcctcgcttgcggatcgcggtcgcgctgatcgactcgatttcttcagtgaggcgaatctgctcgaccttgtagccgacatcgcgcccgtagtacacgccgttgacgttcggcatcgggaacacgtggaagcagccccggcggtgctgaagcgcggcttcgatacgcgtggtgaccgctacgccgtccagcgggttgctcgggccgttcggcatgaagcgcacgccgatgccgacgtagccttccttcgcgagcacctgctcgaacagcgccgcgtggcctgcgtgccacggctggtagcgaccgatcatgagaccctgggggatcatgaagcggatcgcctcggcgatgtgacccatctcggtcgtgtccgcccaacgttcggtcacgtagtccgcgttctccggcggcacgaacatctcgttggtgtccgggtagcggctctcggcaagggtgttcatgaagacggtcaagtccgctccgaacaccgcgcgaatctccggcgtcggcgcaacgaagtcagacacaaccagaccttcgtgcgtgtcggcaacagcgcgcatgcggtgcgcctgctccatgcggccttccagcgtgaagtcccaattgttcgccgcctcgcgcacggcatcgccgttgacgtgagcggcgttgaggcgcgcggcgagttcccgcgcgaaggtcgacttgcccgagccgggcaggccgcagatcagaatacgcttagccattgtgctgttccttttcgatgcgaagttcttcgcggatttccatgagcagtttgccgagatggttctcgcccttcccgtcgcacacgccccaatacttgtcgccccaccaattgccttcgacgagggttgcgttgccggtcttcagcagcttcgacttcagcggctcggtgccgaacttctggcggagcagctttctcatgacgttgatcttgttctcttcccatccgtcgcgcagcactacgcgcttaccgcgccgcttcgcgcctgcggcgtccggctcgttacggatgcgtcgacgttcgtccatgtcgtcggtctttgcagcctggaacgcgtgctcgaccgtccggtaggagtggccgtcgaaaacgacagcgcacgaccagaagttcgagaggaagcgatacgggcctgcgaagctgccgatggttttcatggtgcctcctagtggatgatcttggccttgccgaacaggatgcgctgcttctggatgtcagtgcgccggatttgttcttcgagcgagacctgcacgttggtcttcatcatcgcgtgcaggtggcgcggctctacgaccttcccggtgacgaacttgtagatggccgagagcagcgacgggttatgcagctcgaagaaactgccggtaagcacccaggggttgtgacggatgctgctggcgatttcgatgagctgcttctcggcctttcgcagatcgagcggcggcgtgatgcccagggtctccatgctgtgcgccacttcgcgcgcaggccgatggacgatcaggaactttgcgccagggaaccgcacgacgagatggtcgaaaaagaacatcgcggccacgtcggagatgaaagccgggccgggcggcatgccgtcaacaaccaggcccagctcgttgatagacgcgcactgctgcaacgggttgtgcagagacgcgcagccgtggccggtgcccgggcggacgaacgcttccatccacgcgctgcgactgcgcggcaggctcagcatgatcgtcaggtcgtggtactcacccatcggcgttctccttcagccgcgcttcgagcaaatcgcgcatggccgatgcgcccttgcccagcggcacgtagaaatggacggtggtgctgtccatcgcatccatgaagaagtgcttctcgtactcgaaccggtgcgagggggtcggatcgccgacaggcagctcttcctgcttgacttcatgcgagtagagctgcggcggcgaggccgggaacaggaggcgctggccgtccaaggggccgccgatgaaatacgcccgcgcgctcatcgctcgcccccgtccccatgcagcacgccgcgctccttgcggtcggccagcttgtcgcggttgcccttcagcaacgccacgtagccgccgctgccgcagtcgaccaggggtgcggtgcgctcggcgaactcgaacgagacgttgaccatctgctgcaatgcctgccgcatttcttccagcttcgcggcggccttggcctcgtcccactgcatgccgtcgcgcatggccttcttgacgacaccctggacgatgcccgcgtgagtgcagagcgccgattgcagatcgaagccactgatccgggcttcgcggtagtgcgcgtcggcgaggcgcgtggctgcgttgcgcaccatgatggcgaacggcggcaggcccttctgctcttcgcacatgcgggcgatgtaccactgcacgtcgcccagctccttccacgccttcgcgtatcggtcggcgcggtagtcgggcttgaccgcttcttcgtcgaacagttcggccagttcgccgacctcgttgccgatgcccagggcgacgtacaggacgcccgcagtgatcgcaacggtgctgagcgtggtcggatacttcgcggtggtctcggtgaactcggcgtagcctgcggccgctgcgtgggcggcgttgacgaaggccagtcggtcttcccgcttcagagaaagagtgctcatgtgggtctctcaggtcagggtgtggggaaagtcggaggcgtactcaatctcgaacaccttcgcgtcgtcgtgcagcaccagcgtcggctcgccgtgcggcggcgggacaaccgcgaagtcgacaccgcgcgtcagctccgtacgcgagcctacgccgtcgactacctgctcgacgaagatgcgcacgtggtcggggcgctcgcgagcggccagtcgctcacgctgcaagatgcgcttggcgaccttgccgccgaacgccttgcgcagcttctcttcgacgctgcccttgtcgcgggtggcgaagatgccggtgcccggcttgcccggcactccgcgcttgtcggcgcgattgtcggtctcgttgtcgcgctgctgcaactcgaacaagcggcgctcgtctgccgcgagctgcttcttgcgccacgggctgagttccttcccctgcgcttcgagctgcttctccttgtcgtacgtgcggaacacgcgacgcaggctgcggttgatattgatgtcggctttcatgagtgtccttgctgcggatatgaaaaagcgacccggccggtattcgacagggccgctcgttgtactactcggtcaaggccgacttagcgaccggcgacgaacttggtctgcttctgcaccttgccgcgcttggtctcacggaacagcacgatggtcgtgttgtcgtcggccatgatgctcgcgtcttccagggcaccggcttcggtgatgaacggaccctgcatgccgcctgccttctgcgtgccgtcttcctgcgcggtcagcagcaggtaggcgaactgcttcgcgcccttcttgccccggcgcacgccggtcttcttcgcagccttcttgcccggcgggcggccgcgcttcggagcatcggcggcgaccttcttcggcgcagccttcttgacggccttcttggcggcgatcagcttcttggcacgcggcttggcagcggccgtgccggtggccttggtcttcttcggtgcggtcttcttggcgggggctttcttcgccgccttcttggttgcttcggtcactgcttcagcggtggcgctcatcgggtatctccattgcgttgttgtcgacaactcgcgggatgcgagcagggttcccttgcgggattcggttactcgcagcccagcgtggagccagggtgcgaggggctgtcttgcaggtattccttgaagtcgcgccagccgtctttgcaggcaaagccccagcggcggacaatcgagccggtcatgaacagcgtccagcacggctcggtgttgttgccgaacagctcgatcatgtgcatgtgcgtcggcggcagcttgcggaagtcgccagcgtggaactgctgggtgtagtcgaagcggttctcgccttcgcgcaagccgctgttcacggtcacgctgccctcgacgtatgtgcggccgtcctgcggcgagaacaggtcgctcatcgccatcacgtacgcgcccatctgcttgttatcgaacgcagggaaccactcgctcgtgtgctcgatgtagcggccttcgagaatgagcgaggcgctggcccacgggtggtcgtgcagagcgcgctcgtcgtcaccgtggacgaacttgtgcaggtacaggttgagccagcggttgcgcgggatcaggtgccagcgggtcaggtagggtcgacgctcgccgccgttgacgccatccagggtgatgacgcggctcggcttgatgaagcgcgcgtactgcttgaacgcggcgacgaacaggaaccagaggccgagcaggcgcagcgcgttgtagaagcgacgcgagactttcggtgcagtcatgggtgcgatcctcgggatgacggggtagttcattcggcgtccagatcgttttcgttggcttcggtcaggccgccggtcggagccggaaccgcacgagtgacgagctgcggcgcgggggcgaagtcgatctggtagcgctgacggaggaacttcagattttcctcgatacgcttctcgaagatttcggccagctcttcgcgggtcagctcgccctcgtggtggccgccctcgccgacgacgcgcagcttgtcttccggttcgccgtgcgtggtgaggttgcggtagttgtgctgatcgaggatcaacttgtcgagcgcgtcgcggactttcggcaggtcttgcatttcgattttcatgttgtctctcggcgtgagaattatggggtgccgtatcgtggcaccggacgccgggtttgcacttcgtcgcgagggggcgcgcttccgtgctaccgggagactggcctcggcccgtctcgttgcagctcgatcttacccggtggggagtccgaagtaaaatcgctactgcggggccactctatcgccagctccggggcttgtcaacacccctccgcgaatccggcggacggctcagccgggccatctttcgctcccctcggaacagccggtcccgcagcatcttttccgtgacgtgcgggcagttgcgttgaatctggtcgaaggtcatctcttcgccgtcgatccggtagagcctgaccgtccccacgcgcggcagttcacccattgcgtgcgccccgtccgtacgtttcgaggtacacacgatgcagctcttcgtgtgcgatggccttgcggaaccccttctggccgaccagggcgtgcgcgaagtcgtgagcactcggttccgggttgccgatgtgctccgtcatgcgcagcgtctcgttgatgtacgcctgcggctcgccttcgacgtagccctcgtccgcgagcaacccgtggatcgcctcacggtacttccggttgcgatgcttctccgcgaccagggctgcgaacagcgtgaggttcgagagaatccagagcgccgtcgccgcgtccatcactcggcctcttcgtcgtcttcgacttcgcggatcagcgacaggtcgtacatgccgtcgccccacttctcggcggccagcgggccagcctgccgcgcgtcctcggcttcgatgtcaccaacgtggcggccgtctttcacgatgcgatatttgggcattgcagttactccggtttgggtgagatgtgcagggtgtcgagaccctgtttgatgcgcttttccacgtgcttgccgaactcgctcgcatcgccgaacaggatgtcgaggtcagggtcggagcactccgctgcgatgccgcgcattacgtcgagcagcatcggcaggtggtgttgcgagctgtagttctggtggatcatcggccacgcgccttgccgcttccaccacgtcttgcgttcgccctcggtcatgccgacgtagatgtcgatcatcgcgcgggccaggaacggcgaccagaagcaggtatcgaccggcgtgatggagtcgccgaactcatcgagcgcgaagtacaccgcgaagatcggcacgccctcaacggtgtagaccggctcatcgagcatgtccttgtacgtcgcgatggtgtagccccggtaaggagccatgtgttcgtagcggcgcttctcgggcggcgggaggggcattggaaagctctcgttgaagtacgggtctgcggtggcggcggcatgcatgcacgcctgcggcgggtcacgtgcggcggcgcgcatggccgcgtagttgcggtcactcatgcgccgcctgcgtctcggatcagcacgacaggctcaccatcggcgtccccgtcaggcaggcatgcggcgagcacgtcggccgcgccctgggcgtcgccgagcacgagcaactggatggcggcgcggatcgcggtttcggtctcgactgctttgcgttcggccgccagcacgtaccccgcaccgtcgcacagctcttcgagcagatgccgcaaccactgtgccgccgtgaggtctttgcggtccaggctcacgccatacttcttcagccctgcctcggcgcgctggcggatgatcgcgatgaggtcgtccgtggtttgcatgtcgctcatggtgtttctcctagtagcggcgcgtcggcgtcttttcgacaacgcggatgtcgtgggcggggaaagaatgctcgccgtcgttctggtcggtgacgtggacccaaccctggtcgaacgtgcagctcttggcgttgcggaagatcagcggcggcgctccgttaaacgtgatgtcgactcgcatcacagaaccctcgtcgtgatgtgcttgcacgcgccttccgtcaggcggtagtcccacatgctcttgtgcttctcgcccgtggccgcgtcgacgatccacgacacgtcggaaacgccgaaacacttcacgcgtgcgatgccgatccgccagtcgtcgccctgcttggcctgataggtgcaagcctggaacagcatcgcgttgctttcgtcggcctcttccttctcctgcttttcgatttccagcatctcgggcgtgatgagcttcagaccagccgccctcacgtcgatattccgaccgtcagacatgcggatgctcacccacgtgccctccatgttgttccacacttcgttgatggtggcgcgctcgcccttcttgatgccgtcgatcttgcgtgccagtgccgtcttccagtcgccgggcgacatgtcgcggacggcttcgacggtgtagcccgaaatgacgctgataggggcacccgccacgttctcaaagctgacccgacctgcgagtccagcgtagtggtcgttcatgtcaaaactccttgtggaaatctttctcggcccggatgagagccgaaaccttggggccgaactttttcggcgtgtcgagcaggatgtcggcggcaccgattgcgacctggggcgagatgaaatagccctggatcggatgcagcacttcgccgaactcgtcgacgatgtagtaggcgacatgcacgcccactccgtcgagcacgatcagcgggccgccgtcgctgcgcacctgctcgctgtgcagctcggcaatgaacacgtcgcggtatggctggatgcgcttgtacttcatgcggccttttccttcaggtggtcgagctgccagcccgcttcgattgcagcgaagagccgcagctcgctcgcgtcctcgtggtcgagcttcagcagcgtcacgaaagcatcgatcatctgcggcgtcattgggcgcttgtcgtagaacctgcggtacgcgctgttcgggtgcatgtcccacacgtcacacaagtcgacgattcgcttgccctcttcccgcaggtgccgacgcatgatgtcgcgcgtggtcttcgggttcttctttaccgtgatcttacggccggtggatggacggaaactcacagcccgatgtcctccgcttcttccttctcgtgttgcttcagccaatgcgtctccggcaggaacgggaacgggccgagccaaccgataacgttgccgtactgcttggcgaacccgtactgatcgtgccaagcgtcgcgacgccacacacagacgcggaactgcttgtagtgcggcgactggcccggccacggttgcaacagcaccgcgtagtagcccatctcgctcgggtcgtcgagcacttccatgtcgttcagcgagagcggcccgtaccacccgtaaatctgagtgtaggtgcgcgacttgtgcagcgtctcgaaccacccgaagcggtcgttgaactcgaagacgtggtacgcgcgtcgcttgctgttgatcgtcgggtagtcgcaaacctgcacgatgtagaaaccggcttcggtcacgtcttccaaggcttcgagttcgagcattacggcagctccacgtttgtgcgcagcgggcggatgcggggcagcgggccgacccaaccgtggacttcaccgcgatgctgctggtcgcttcccaggtagtaccaatggccctcgtaccacacgaggaacgcgtcgacgacgaggttcacgaccttggggtgatctacgcggactgcgtagacccccgtttcagtcggatcgccgatttcttcgtattgcaccttcacgggatgcccgcctttgccgtgtactcgctcaacttgcgcacccagctcacgcgatcctcgatagggatcgacagcagcgaagcatggccgaactccttcagcatctccttcatcacttcgaggcccttatcccggccgaacgtgttcctgaatgcacgcgaggcgtcacgggacatctcaccgatccaaccttccatctgccggatgcgctggtcccgcttctcgacgttggcgaggcgctgctccgcgagggcttcgacttccttcagcgaatccttgaaggcaatcagctcggattcgacctgcacgccgccacggaacagcgtgcggatggcacggatgatgagcgcgcagtcgtcgtacagcacgcccggcggatcgtagtcgcgccaacccggcacacgacggtccagctcgcggccgatgacgcgaatccaacgcaccgcgttctcgccctcattgtgcgtcagcatgtcttcgcggacttcctgcatcaccgcgccgttgtcgttctcgatgtcgatgtagacaaccggcttgacgttgccctcactatcgagcggacgccatttcgcgagccactgtgcatgatcgcggaaagtgtgcttgttgcgaccgtagtggacgccgcccttatgcgtgtccagcgtcaccgtgtgcgtgttgaagtccccctgctgcacgtcgaccaccgtgtagatgtgctcgctgccgacgcgctggtactgctcgccgaccttcggcggcagctcattgccgtggaagggcacgccgtcaagcacctgctgcgtggcgtcgacaacgttcctcggcgcttcggcttcagcgacaaactcagcctcgacaccgctcgcgcgctccgaccgcaggaacgcctgggcgtcgagctggtacgcgtacgggccgacgctgctctgcggcgacagcggagccagggcggtctcgcggtcgacaggggtgaagaggtcagcccacgagcgcgtgctttcccacacacgatcttccggctcgccgtcctgcaagcagtgcatctcgacatgccagtggcgcacgcactgctgcaagccggtcacgcggtagaacttcgtcggctcagtgcggctctgccagtaggagttgatcgagaacgccgggccttcgttgtagttcttcgagtagacacgttggtcgaagctctccatgccgaccttcttggcccacttttcgaggtcgccgatcacgtcgccagtgtcgacgcgcagctcgatgttgacttccttcttgcctgtgcgcgcttcgatgtccagcaggtcgacgcgcagcaggtcgagaatgcccggcgagagcagcatggcttcagcgatggcgtgcgggtcgatgtcgtcgagcacgatatagcgacggtcattgtccttcaggaagtctatgctgccggaaagcatgtggagctgagtgcccgggaacaggtcgcgccccgacgtggctcggaacgccgcttcgctcttgccctgaccgaagctagaagtaaagccgccggagtggaagcccggctgcggcgacggcacgacgccgttgtgcgattggaacatcacgatgtcctggccggtgaacgtgactttggcccactggaacatgcgctcagcctcggccatttgaccgtcatccaggccgatgtggtagccgcgtcggcggtggatagagaagacaatgccctcgtcgttgcaggtagcgatgaggggcagaagcaccggcttcggtgcgttgttggtgaactgcttatcgtacatatcggcggtccttggttgggttaggtggtgcttacgtggcctgcggcttcgcggtcgagttgcaggtcggccatgcccagcaactcttcgtcccaatcgtcaagcgacatccagccgttgacgtgccagtggaggtcgttgagcgtcagcctgggccagaagtagctgtgatccagtttgttctgctcgatgtagcggttgagtgctgcgccccacttctgcgcctcgacctcgcgccacgtcacttcaccctgaccgtggcacagcatgcagatgcggatgtagttgtcgcggagctgcgtggctccctcgcacgccgggcacacctgcttgtcgcggagccagcgggagagcaggcgcatgcgttgccatgcggccagacggattgcagcgagcagtagggtggtggcagcacgcgcgcgagacaaagggggtactcgggcattctgaaaaaccgaaaccctttgggccaacattttgcccttctccaattccatcacggtgtacttgcgcatggccgttactcggtgcgagtgatggtcaggaacgcgaacatggcgtcgttgctggccgtcatgtacgagccgcgttccatcgtgaagcgcttgcttgcgtgctcgggtgcgctgcgcaccttggcgatgccgccggacagcaccgagttcttcgccttgaagaacgattgcgcctgggacgacagcgtggggccgttctctactacgaatcgacgcacgtggcccagcgactcgccgactttgagcttgctgatctggtcgttgagcgagccgggcaggaacaggacgcgcggcttggcgaccttcggcttggcggcggtgctcttccgcttggccgcaagttccttcttgacggtggtcggcatcttgcgcggcttcttgggggcggtcgtgctggtggtgctggcggatgccatcgggcgaatctcctgtgccgtggttggagtaaagggacaggacaaatactactgcgcggccgggggcagttgtcaagcgcccggttctcggtcgtgaccggccgggagctggccgccctgctgcacaaaggtccggctgggtttccgaagcgggagaaaaattgggtccggctgggtctccgaagcgagagcgcgctggctttcgagttcggtttcggcctgccgtggatttttggaacgggctgactttccgaagcgggggctttttctgtaccggaggcatacgtgtacgcggacgcgcgcacgcacctgcacgcacacccgcccgcgctcctgcacaggtcacgcgcctcacctgcgggcgcgtgtcaatgaacgcgcgccgcgcgcggttcgttctcctggccgcgtcgctcatcctgggaagcgctgaacgccgttcagaaaaataattgaaaaaagtatttgcactactgcgcgaggggtgctgtaattcttccaccggcaggcaacaccgccccggcaactaacaaagggaaagcaaccatgaacgcaacgaaccgcaccgccgccattcgcgaagccgccgccctggctgattcgatcatcgaacagcgcacccgccttgccgctggctgggatcagggtatgaagcgcgacgacgaaccgcgctttaccggcgtcaccccgcgcatgcggatggaacgcgacagcgccgccgctttcgcactgtccgcgcagttcgccaccgacgacgtgcgcgaaggcggcgcggttcgcaacgtggttgccaagctggcccacgacatcgctacccctgtcaccgatacggagattcgcgcagccgccgaccgtgctatggcgctggcccgtgacaccctggcgcagcgtcgcccgttcctgggcgtgttcggtgccgccgatgaatccggcatcgccgacgctgcaatggcgaaggtgtgcggttatgcctatctggcgatcatccagaacaacaccgtgagcatcacgacggacgccgacggcatgctcacgaaagcgtgcctcaatcgtgctggcgtgatcctggccgctggcgacgccgttaacgccctggtgcaggcatgagccgccgcagtcgctccgactatgacgcgcacgcgggcctgtccgctgcgcgcagcaccgcaccgcgtccggtgcgcaagcctcgcgcctcgctccccgtgtcgcgcgtcctgggctggctggcgtgggttgtcgtcgccgcagccgcctatcactacgcgccgcgcgtcgcggcccttgtccgggagttcatctaatgcgcgctttccttatctcgctccctggcgtgccggtgttcaccgtccacgccgatgaccgccgcaccgctcgcaattacgccctgggcttgcacggctacaccgtgcgcccgccccgctttatcaccgtcacccccgtctaaggaatcgcacacatgaccatttccctttcccaagcgttcgcacagtggcaggagttagccgccgacattccgaaggatgacggcccggccctggccgaatcgtggaacgactacaccgattcgctttgcaaagacggcgagttgtgcgcgcttcagtatcactacgcgcccgcctatgacgacgacatgcccggcgaaggctcgcgttacgatgaactaagcgatgatcgcgctttcatcctggaacagatgggcgtgaccatgagcgccgagtttgtgccgtttcacgcgtcgcgcaacaaagatgaaaaatcgccgtcgcttaactggcgcgtgacgctgaagaagggcgaccgcgaagtgttgacgacggattacatgcaaggttgcgggcactgcccggcggaacagcgcaacaatttcaacacgccgaccgtcaacccgaaaaccgaaaagcgcgccgccattgcgcaggaatgcgatacggggttcgaggcgaagggcggaatgatgggcggccagttcaagcgcggccgcaagctagagccggaattggtggacgtgttttatagcctcctgtccgactcgcgcgtgttggattgccgcgacttcgccgattgggcgagtgattacggatttgattccgacagcatcaaggcgcgcgctatctatgacgcgtgcatggccgatgcgctgaagatgcgcgccgcgttcggcgataaggcgatgggcgagcttcacgaactgttcgagggcatgtaatcatgagcgacgttatccactcctataccctggaacgcgacggccttacgttccgcgtcgatcactgcgccgacaccgacaacggcgcaccctgggaaaacgaagatggtcacggcaccgtgtccgactggactacgcgcgacaagtcgccgggcgaattggtgttgaacaccgatcacggtagcaaacgcttttatgacttcgccgacgcgtgccgcatcgcgctgcgcgacggctggggcgcgcgtggcgctgaagagggcatgagtaagcgccagattgccgcgctcgccgctcgcgaggattacgaacaccttcgcgcatggtgcaatgacgaatggagctatatcggcgtcgtggtgacgttgctggacatcgaaggcaacgaaacggacgcgacggattcgctgtggggtgtggacgataatggcgactacgcggccaccgttgcgagcgattgcgtggacaacgtgatgcacggcatttcggccatgctgtatggcggcgacggcgcggtgtacatgagcggttcgcgttcgtggagggtgaaggaatgaatatcgacaaccccgcccacggttacctgcgcgacgcgttgcaggccgcttacctggaatacctcaatgcgtttttgacggttgcacgtttcgccgcgcatcacgacattgacgaaaaaaccgcatgggcgattatcgacatgggccgccgtatccacgaggagcgcaccgcatgaacgtcctgtcgcatggcgaacacgtcgcctcaatcaaccgcatgcataaggccgcagacggctacacgccggaaacgccgtggttgctgctgcacaacactggccgcgtcgaccgcttcgcaacgcaacgcgaggcaaaggaagaagcgcgcaagagctacccccgcgttacgttcgaggtgcgctaatgatgactttctcccttgtgttggtgttgatcctgggcggcgagcggcacacgttcgtcatggatagcggcctgaccgcaggcgattgcgtgcaagccctggtagacaaccccggcgcgcctttgcgctgcgaaaaggagtgaccgacatggccgattccctggaacgtctcgccctcgccatgcgtgcgcaggccctcatccaccgcgagcgcggcaggcacaaccgcgcaaaggaattggaggggttcgccttcgccgtggaaacgtgcgccgccctggatagcgccacgttcgcgccaatgccgtttgccgtcatgtgtcacaccctggccgaccgctgcgccgacatcctgcgcaacgatgatgcgcaagtgcgggcgggtcagttcgagcgactgcgcgacgccgaccgcgtggccgtgtctcgcctgcgcgcttatgcgcatggcgtgggcgatgaggcagacgccgcgcccgaactgtttaaggagacgcgcccgtgagcgttcgcattgtcaaaagcccgggccgcgctaacttcccctgggcggtgcagttcaagccgactgaaaattggtcgactgctgcggcctacgccgacaaggggccagcggtggagcacgccgaacggttgcaggcggaatatccgcatctgccggtgcgtgtgcagcactacacgggagggccgcaggcgtgacgccctacacgtattggctgcgcagcactgaccccaaggcgcgcgtattcgtggctgaagggccgcacgaacgcgacacgtcgctagcgctcaccgcgcgccgcctgggcgtcaaggtgtcgacctcgcgcggcgtggccgtgtatggcctggacacgacgccggttgtgcgcgtggtgaaggaggattgacgcatgaccctggaaccactgaccgaaaccgaaaagcgcaaaatcatccgcgcaaacattctggccgatagtctgctgcgccttgtgcagtgggttgcgttcctggcgatcctgggcgcgcttgtcctgccgctggcagtgcaggcgtggcacaaggccggtgcgatcaccgccgccgtggtgcttgccctgggcgtggcctgcgcgtggcacgtcaagccacacggccgcagctacgcggcgcaggtgcgggacatcgaagcccggcacaagccacacgaataaaaccccgcacccccacacccccacgtctgccactgtctagccctcgctcacgcgggggctttttattgcgcgttcgtctgtccctgggcgctcgccctggccgcctacccttgggcgcgcctttccctggtaacgctatggcctgcgcagtgagcacacctgcgcgcccgcatttgcgcatttccgcattgcgcacgtcctgctgactcgctaacggcctgcacctgggcgcacgtcctgctgatttgtggtcgacctgcggcacacccgatagccctgcacctgggcatttcccgcattgcacgcatttaatttattgcatgggcctagaggcgcgtgtgcgcgtgcgtgtgcgcattgcatttatttcccttttattcgcatcaccgcatggccgcgcggcccgcacgcacgcattgcggcggcgcaggagggtaaaagggatagcggcgatgcgagtaaaaaggtacttccggccctggcgcgggcgtcgcggggggcgctgaccccggtgctcgcgcatttttcaattttttcgcatttccgtctcctataaggggccgaaccgcgcgctgcaccgcatttccgggctaggaattaatttattcgcttgtgacagtagtgacactgacgatttgcggtactgtcacaactcggccccccgcgcaaacggttgatttggaagggttttgaggtcgatttgctactgcgagttgggcctttgtgacactgtgacactgaaaccttctcccttaccgggaaagaaaacacgaaaaacggccacaaattagtaccattgctaatatttgagggacaattcgtattcctgcgtgtagcagaaggtactgtcactactgtcactactgtcacaaaataagaggaaaagtaggcaggacaagggtttcggcttgtgacagtaccttgtgacagtgacgcttttttcgccacatcggcccaaattaattcgtcagtgtcacaaggagttaattcccgggcttgtgacagtaccttgcgcgattggaaagaattgccgataattaattcgccggaaattcgtccggcacaccgagaaatgccgatgatcgctgaaaccgacgaaattgagagcacgcgcgctgacttcgaggaagccgtctacaagaaatatttcgtgtcgcagatcagccgcaccctgctgctgaaaaaaggagtggccgacaaggcgaccctgctggaacggaaaaagaaaggcgcgtaccggcggccggaaattgccgcgatgtggttcgggtggaaattgcgcattgaggccaagccggacccggcatggcaggatcgagtcggctaattcggcgcaacgaaaaacccccggggcgacccgggggtttctttttgcctcgctgccggtgtgcgtttattcgacgcgggtgtccggcacgttcgagccgggttcgccagcgcccggcggcagatcgcggcggccttcgtacgcagcggcgtcggtcgtggcttcgtctacggtggcctggggctgctgcacttccgacttggtgctgccgaagaactctccggtctcgtcgatggtgagctgctggcccgagtgcaggctcacttcgatgctgcggcccgggccgagttcgccgacgctgttgccttcgagcttgacggcgagcgccttgttaccgtggacgtacgagagtttgacggtggtggtcattgcgtttctcctgtgccctggattgggcggttgtaggttacatcttgatgcgtgcgagttcgatgaagtcggtgatccaggcttgcaggttcggcttcatcaccagctcgggatgcttcgaccaatagcgcgccagcttgccgctcgcaccgcgcgcccggccaacgtagacgaagcccttggcggtcaggaagttcgacagcttcggcccgaacggaactccgcacgacgcatccagcgccgcgtcgcgcagcctgccgacgttgagcagcatgttgttgacttccgggtcggtgctctcgttgatgatttccagcagctcgtcttcgtcgtcgccgcgagccaggtcgatcatgcgttccttggcgtccgtcatcggcgcgtggccgtccgggtcgaactcgggatgcagcgggtagtcttccagccactcgcgcagcgcgcccgcgtgataggcgatggcgttgaagatgtcgtcgtagtggtcggggtgctgcgcgcggaacttctcgatcatctgcttcgtctggaagtgagtcgagaccacgaagtaccggcggtcggcgtcgtacaccggcagcgcgtcgctgtgattggtcaggatgatcgtggagctgacgttcggcacgttgaagccgccgctgtgcatcttgcggatgtccaccacgtcgttcgtgatgtagggcttcagcttgtccatcacggcgtagcgcgacgtaccggcgatgcgggcttcctcgaacacgacgaccttgttgcgctcgtagaactcggtgtacttctcttccaggcgttgcgcgttgacggtgatgacgttgttcttcgacaggatcgccatgagcatttcgccgacgaaacccttaccggcaccgtcgataccctgcatcaccacggcccagcgaatcttcttgtccatgcgcttgatagtgaacgccagccaggacagcagcagctcgcgctcgcgctggatcgggtaggaaatctcgaagtgacgcttcaccgcctcgaccgcacgccgcgccttgccgcccatcttctcggggatcggcacgatgtcttccgggttgaacaggttgacgtgcttctggtcattccattcaacgattcgctcggcaccgggcaggtacacgtagccgctcacgaccggaacctgatacacgttgagcgccagggccgatgcctgctgctccggcaccgcgtccatgttcgagcgatccttcttcgacagcaggtggcggttgttgcgcgcgttgaacgcacgctcgctcagcgcgacgcggttctccatcaagaagaactcttcctcggtgtcgacgtacaccacgtcgttgcaccagaacggcagctccttgtagttgaagtcggaattgcggtagccctcgttcaccgccttgcgtacggtcgcgatgctcggcgacttgccggtcagctccttgacgcgcttctggatttcgcccaccagcagctcggcctgatagtcgtgctccatcaaccggccccacttcttcgccagcgggccaagaagttccatcgcgctttcggtctcatgtaccttgcgcttgatcttctcgaactgttcctcggcgacctcctgccggtgctccttcgcgatcttgatgagcgatgcggccgtggtgatgttccggcccatctcatcgtggaacgtgttccacttttcttccagcgagtcggcgtcgtattcgctcgacgtttcggaccactcgtgccagagcgacaggccctcttcctcgccgtcgaattgatggtgcagcgccatgccgaccttcaaccactgctcgtagtcgtcagcacccggcacccattgcagcacctcgcggagctgatcggcggtcaggttttcgagcggctgcttgtgcgccagcagtgcgcggtcgttctcgtcgtcgatgtcgtcgcgactcgcatcgcgcggtgcgttgtgcttcttcaacgtccagccgcgacgctgcgcttcgagcttgaagaccgagaacaactcgtcgatggcgtcggtcgtgatttccggcagcatgtcgtgcggcacgctcaccgggttcatgcccttgccggaagtccagcggtacggcttcttcgtctccgggtgcaggccgatgccaacaaactgctggccgtcgcccaggacttcgattgcgtgctcggtaccttcttcgtcgacgaaggtgatcttgcgcttctggaacgggatgtcggtgcggtacacgagcatggtcttcggggccatgccgacacgcgtcatcgtcttgccgcagatttcaagcgcgtgctcggccatcaactcggccatctcggcgtcgtagatgtcgatgtccacggcaggcgtgtgcttcgtcaagaagccgatgttgccctgcgtgtagtcgccgctcgcccacttctttaccagcttcggcgttgcttcaatatgctgccacttcggctcgattgggcctttccgtcccttcggaatcgggatgatggagtagccgttttcgagcaactgcgcgccgtatttgcgaagcacgctggtgatcggtcgtccagccatgtgcgtcactccgcgatgtcgtcgccaacgaggtcttcgagattgaatccaatctcacggttgaagtctttgtgcaagatcgaagccttgtcgcgcggcacgcatccgagacgttgccaacgcgacacggtggtctcgtgccagttgtacttctcgcagattgcgttgagccgaccgtacggcgggtcgagcattagggcgatgcgccggagtagatagcggacgcgcgcgtcggcgctgtccagtgaatcaagggttaggtctcggcgcatggaatcctcgcggcgtgtgggtttcaaggggtctgctaagccgctttgcgtgcctattgacttagcgttgggacgggcgcatagtgcgctcgccgggcaggaattgcaatccgcccgtcactcccaaaaccaacctagctaggagcaacaaaccgatgtccaccatcaacgcgaagaagctcgccgccgccatcgttctcatcatcgaagccgtgggcgggaccagcagcaacagctccgtcaacgaatccgaagacggtggtgacgaagaagaagcgccgaagcgcggtcgcggccgcccggcgggcagcaccaagaaggcaccggccgagaaggccgctccgaagggcaagggcaagtcgaagcccgacccgctggacgacgaagacgaagaagaaggtgacggcgacgaggacgaaggcgacgacgacctcggcctggaagacgacgaagaagaagtgacccaggaagagctggtcgcctccttcaaggcgctgaagtccagccacggcgtcgacgcctgcaagaaggtgctggccctgctcgacgagagcaacgtcctgaacattccggccaagaagtacccggaagcgatgaaggaaatcaagcgcgcggccagccgcaagaagtaattcggcctgcacgtaacacggacgcccggcgatgccgggcgttctttcgagaggacacgatgaagccacgtcgcaacaaactcgcaaaggccgtcaaggaagcagtgcgtgcgcatgcgcgctttgcgccgtcgtctgcacagcgcatcttcgactgcccggccagcttggtgctcaacgagcaggagccggacagcgagaactacgaggcggccgaaggcaccgttgcgcatcacatcggcgagacctgcctgttgaccggcaaagacccggaagagtttctaggaatggtgttcgatagcggcaaccttgatgccgactacgacgaagagcttcattcctcgaaaggcttcgctatcactgttgacgacgagatggttgctggcgtcggtcagtatctcgattacgtgatgcgtctgccggggtgccacttcgttgagcagcgagtgaacatctcgcggtggtgcccgatccccgatcagttcggcacgtgcgaccacgcagcggccatgtacaagaagctggtcgtcaccgacttcaagtacggccgtatcttcgtcgagccggagaacaacttccagctcatcatgtacgcgctcggcttcatcaacgagtgggactggctgtacgacttcgacgaagtggtcatccgcattgcgcagccgcgcgtcgagaacttcagcacgtgggtcacgagcaaggccgagctgctggctatcggcgagaagatcaagaagcgcttcgccctggcgctcagcaagaacccgccgttcggcccgagcgagaaggcgtgccggttctgcaaggtgcagtacaagtgccgcgccaaccacgacttcctctaccaccagcgcgtcatgctgctggacgatgacggggacttcgttgaagacgacctcacgatgatgagcctcgaagagctgtcggcggtgtggctgcgtaagagcatgtacgacaagcgcatgggcgctatcgccgactacctgcacaccaagatcgccaacgacgagtttgtgcccggcctgaaggtggttgcaggcaagaagtcgcgctacttcaccagcgaactcgatgctgaaatgctcatggtcgatgctggcatcaagcccgaaaagctgtactctaagcccgagtttatttcgccccacgccgcagagaagttgctgcgcggcgaggcgaagaagaaattgcaggacttcatcgcatcgaagcccggcaaaccgtgtctggtctccgcagacgacaagcggcaagacctgaccgtgcagaagttgtcgctccttgatgactgacgcacgtagtagttcgacaatcccgacaaccgacaatctcgacagacgatagtctcgacaacgataggagcaacaccgtggctaagaagcaaatcccgcagaacgacctcgtggacaagggcgatggtcgctaccttctgaaaggcgctcgcctttcgttcgcctacctgcacaaccccgatgagcaggaaaacgatgaaggcaagaaaaccaagtcctaccgcaccgcgttgctgatcccgaaggcgaccggcgcacgcaccaagaagaagttggacaaggtgatcgccgacctcatcgccgaagagtacgacggcggcaaggtgggcagcgacaagcgcttcctgcacgacggcgacgacggtgacatcgcagagcacgagggccattgggtcgtcaacgttcgcgagagccgccgcccgacgctggtcgaccgcgaccgtcagccggtgatggaagaagatgaaatgatctattccggcgcgtgggtcaacgctgtgattcgcccct

SEQ ID NO: 12 - DNA, 56132 bp, Unknown
  Bacteriophage Xfas102
gcgcgtcgagaacttcagcacgtgggtcacgagcaaggccgagctgctggctatcggcgagaagatcaagaagcgcttcgccctggcgctcagcaagaacccgccgttcggcccgagcgagaaggcgtgccggttctgcaaggtgcagtacaagtgccgcgccaaccacgacttcctctaccaccagcgcgtcatgctgctggacgatgacggggacttcgttgaagacgacctcacgatgatgagcctcgaagagctgtcggcggtgtggctgcgtaagagcatgtacgacaagcgcatgggcgctatcgccgactacctgcacaccaagatcgccaacgacgagtttgtgcccggcctgaaggtggttgcaggcaagaagtcgcgctacttcaccagcgaactcgatgctgaaatgctcatggtcgatgctggcatcaagcccgaaaagctgtactctaagcccgagtttatttcgccccacgccgcagagaagttgctgcgcggcgaggcgaagaagaaattgcaggacttcatcgcatcgaagcccggcaaaccgtgtctggtctccgcagacgacaagcggcaagacctgaccgtgcagaagttgtcgctccttgatgactgacgcacgtagtagttcgacaatcccgacaaccgacaatctcgacagacgatagtctcgacaacgataggagcaacaccgtggctaagaagcaaatcccgcagaacgacctcgtggacaagggcgatggtcgctaccttctgaaaggcgctcgcctttcgttcgcctacctgcacaaccccgatgagcaggaaaacgatgaaggcaagaaaaccaagtcctaccgcaccgcgttgctgatcccgaaggcgaccggcgcacgcaccaagaagaagttggacaaggtgatcgccgacctcatcgccgaagagtacgacggcggcaaggtgggcagcgacaagcgcttcctgcacgacggcgacgacggtgacatcgcagagcacgagggccattgggtcgtcaacgttcgcgagagccgccgcccgacgctggtcgaccgcgaccgtcagccggtgatggaagaagatgaaatgatctattccggcgcgtgggtcaacgctgtgattcgcccctgggcgcagaacggcaagtcgatgaagaagaagaacaagtacggcaagcgcatcaactgcggcttcgacatcatccagcacgtgatgcacgatgatccgctcggcggcgcaatgcgtcccgacgtggacgacgtgctcgacgagctggacgacgatttcgacgacgtggatgtcgacgaggacgaagaggacgaacgccccgcgcgccgttcctccaagaagccgtcgaagtcgagccgtcgttctcgtgacgaggacgaagaggatgaagaggaagaagaggaagagcgtccgcgccgttcctcgtcgaagaagccgtcgaactcccgccgccgttcgcgcgacgaggacgaagacgatgacgacgacatcggcctgtaattcctcgggttgacagtgctacttcggtcgcccggggcttgtccccgggcttccgtttttctgagaccagcgcatgcaaaagcctcaatacgactcgacgctgcaccacgacttcgagaccttcagcgaatgcgacctgaaaaagcacggtctcaaacgctacgccacgcacaggtcgaccgaagtgctgttcctgtggtacgcgttcgacgacgaagagccgcaggtatggttcccgaagacgcagatgatgccgaagcgcctgcgccttgcgttgaagaacccacgtgtcaagaaggccgcgcacaacgcgcagttcgagcgcgccatctggctgcacgtgctggacatcgatattcccgtcgagcagttcgagtgctcgatggcacacgcattctcgctggcgctgcccggcgacctcgatacgctctccaccgtgctgcgcctggacgacaagacggcgaagatgaaggagggcaaggcgctggtgaagttcttctgccagccacgtaagccgaccaagaccaagcagtacacccgcaacaccaagctcaccgatccggtgaagtggcagaagttcctcgactatggccgccgcgacgtgatcgccgagcgcgctgctgcacgcaagatggcccgcttcccgatgagcgcgttcgagcagcgcttgtggactatcgaccagcacatcaacgagcgtggcgtgccgttcgacaaggcatacgtcgaagcggcgctgcgcgtcatctcgaaggagaaggcgcgcctcacgaagatcatgaagcgcatcacgggcctcgaaaacccgactagcggcacgcagctcctaccctggctgcgcgagcgcggctatccgttcaccaatctcaaatccgcctcgatccgcaaggctcgcgaggattgggattggaacatgaccgacgaagcgaacgaagtgctcgcgctgcactccgaggccgcgcgttcgtctgtcaccaagttgcagaagatgctcgacatcgaagtcgacggcatgctgtgctacacgatgcagttcgcaggcgcaggccgcactgcacgctgggctggccgcgcggtgcaggtgcaaaatttgccccgccccctccgagagatggaagagcagtggcagctccttcttttgcgagaagcgatcatggccgaggacatggattgggtccgcatcctcgtgtcgtcgccgatgggcgcaatcgcgtcgtgcatccgcaccgcgatcaaggcaccgaagggcaagatgttcgtcacctgcgatctgtcgtctatcgagtcggtcacgattggctggctggcggattgtcagaagatgatcgaggtgtttcagaagaacctcgaaatctacaaggtgttcgcctcgcgcatgttcggcgtcccctacgagaaggttgagaagtggatgcggcagcaggcgaagcccggcgtgctcggcgcaggtttccgtctctccggcggcggcgaagtgggcgagtacccggaagtcatcaagaccggcctgctgggctacgcagagagcatgggcattgagatgacggcggaggaagcggctgcggtggtagcgttcttccgcagcgagtacgacgaaatcgtgcagctctggtacgacctcgaacgtgctgtcgagaaggtgatgcgcacgaaggagccgcagcgcgtcggcccgattctcatggacgtgaaggggccgttcctgcgcatgcgcctgccgtccggccgctacctgcactacctgcgtccgcagatgtcgtggaaaaagatcaaggtcggcatcgacaagaggaccggcaagccgaagtacaagtcgaagaagggcttcagctacgagggctacggcgggaagagccgcaaggtctggatgcggatcgactcgcacggcggcaagatcgttgagaacttggtgcaggcgattgcacgcgagctgctggctatcggcatcgtgaccgcttgggacaacgggctggacatccgcatgcacgtacacgatgaaatcgtaggcttggtcaaggcgaagctcgcagagattgcagcgcgcgaccttgaagacgacatgaccgtacagccggagtggtggggcgacgaagtgccgatccgcgcgaaggcagaaaccgtggagtgctatcagaaatgagaggcgacatcctatcaaccgacaagcaccgtctcgaaaaagacgtagaagagaagtggtgcaaggtggcgcgcaaggccgggtggaaggcgtacaagttctcttcgcccggcaacagcagcgttcccgaccgcatgttcgtccgcaacggcttcgtgttcttcatcgagttcaagcgccccggcggaaagcctacggcgaaccagatcgaagaacacaaggagctgcgaaagaagggcatggtcgtgctggtgatcgactacttcgacaaagagttcgccgagtgggtgttcgcatgaaggaacgactcgaacgctcgctactggacgactatcaacgcgctgctggcctctttatcgagagtgtcggcagttgtgctttgtgggtcgacatgggcctgggcaagacggtggtcgtgctcacgcacgtgtccgacaaggtgttctccggcgagtggagccgcgtgctggtcgtcgggccgccgctggtggtgtccgacacgtggcctacggaggtcgatagctgggagcacacgcactggctcgactttcaggaactcgacggcacgcctgagcacatgcgcatgcagttggagcggccgtgcgagattgacggcatctcggtgcataagctggatcgtctcgcgtcgctgttcaagaacaacaagaagccggtgccgtgggacgcgattgtgttcgacgaatcgagcatgttccgcaataaggcgtcgaagcgctggaagcacgcggtaaagctcgcgcaccgccccgagactgacgtgatccagctcaccggcacgcctagtccgaacggcctgcatcaagtgtgggcgcagatggcgatcatggacggcggcgagcgtttgttcgcgtcctacagcaagttcctcgcgcacttcttcaacaaggagttcatggggcgcaagatcacgccgaagccgttcgcgctgaagtcgatcaccaagcgcgtcgccgacatcgtgtacacgctgcgggaagaggattacgtcaagctgccgccgctcattcctcgcccggtgccgatcatcctgcctaagaaggtcttggagcagtatcgggagttcgagcgcacgtcggtgctgaagtggggagaggaagaagacccgaacgtccgcgcgctctcggaaggcgcgttgtacggcaagctgcttcagttcgcatgcggccgggtctacaccggagatgatgagaagaccttcatcgacgtgcatgaccgcaagatcgagcgcatgaaggaaatcgtcgagtttagcgacggctcgccgattctcgtggcgcgcacgtggcagcactcgcggctccggctgaaagacgcgttcccgaacatccgctcgctgaagacgaagaaagacatcgacgcctggaatgcgcgtgacatcgaaatcgcagaagtgcatccggcgagcatcggtcacggcgtcaaccttcagcgcggcggcaacaacctgatctggtacgaccacacgccggatttggagctgtacatgcagttgcgaaagcgcctgcaccgccgaggccagcaagcctcacacgtgaacatgatgcacctgaccgcgataggcacgattgaagaagacctgacccgcgagctggtgcgcaaagaagtaacgcaagacgccctgaaagaacccatgcggcgacgtgtcgccgacgtacagagagaactgaaaaatgtccgcagctaaaatcgactacgaagaagagttcttcaacggcatgacgatcccgcgcctcgcgcagttgttccgcctggaccgccgcaccgtcaccgagaagttgcgcccgctgcgtccgaccggcgaccgccgtggcgcgcccacctaccacgtgtcggccgccgcgccgtacctcgtggagcctatcgtcgacatcgccaagtaccttgcggaagtcggccctggcgatttgccgtccgcgttgcaggcgcagtattggaacgcgcagaacagcaagttgaagtacaaggagaacgccggtgacctgtggcgcacgcagcaggtcatggagattttcgtcggcgctttccgctcgctgtcgcagacgttgcgcctgctggcggatcgcgttgaggcacgcaccgacctgacgccggaacagcgcaagatcatcgagcgcgaaatctccgatgtcgcgttgacgacgctgcgccagcgccttgtggaagacttcgagatgtacgcaggcttcaaggacaaggagcagctcgccgacatcaaggtcgacgacatcggactggacgaggatgagtgatatggatgacctgttttcgtctgcacagctttcccagggcgcgcagagcaccttcaacgacctgggcgaactgctgacctacgctgcgaactcggtgctgctcccgcccgagcgtttgaccgtatcgcaggcagcgtcgaagtaccgctacctcgacaacgaaggatcgtacgtcggcccctggctcaatgaagagacgccgtaccttgtcgagccgatggacgtgctcaacagccgcgattttgagtcgtgcatcttcatcggccctgcgcagggcggcaagaccgaaatcatcttgaactggatcgcgtacacggcgcgctgcgacccggccgacttcttcttgatccagaccgcgcgcgacacggcgcgagatttctcgtaccgccgtatcgacaagatgcaccgcgacagccgcgagattggcgcactgctgcgtcccggcaatgacaacgacaacatcttcgacaagttctaccgcaacggcatgatgctcacgctgggctggccgacgatcaaccagctctcgggcaagccggtgccgcgtgttgcgctcaccgactacgaccgcatgccgcaggacatcgagaagaacggcccgccgttcccgctggcccgtaagcgcaccacgacgttcggctcgttcggcatgacgctggccgagtcgtcgccgtcgttcgacgtgaaagacccgaagtggaagccgccgcgcccggactcgcacatgttcccgccgactgacggcattggcggcctgtacaacgaaggcgaccgccgctgcttctactggcagtgcccgcactgcggcgagtggttcgagccgaagttctcgctgctgcgctgggacacgaagaaccccgatccgtttgcggcttccgagtcgaccgtcatggcgtgcccgaagaacggctgcgtgatcgagccgaagcacaagtacgagatgaaccgacgcggcgtgtggcttcgcgatgggcagagtctcgaccgcgacggcaacaagcagggcgtcggcgcgcgttcgcgcactgcgtcgttctggctgaagggaccggccgcgcgcttcatcacgtggcagaagctcgtcgagcgtatgttgcaggcccagcagacgttcgagctgaccgctgaaacgaaggcgctgaaggccacgatcaacaccgaccagggcgaaccgttctggccgttcaacgctaccgactcgaaccgcctgccggaagacctgcaatcgaacgcgatcaagtgggccgagaagaaggtgccgtacggcgctcgcttcctgctcgccaccgtcgacgttcagaagaacatgttcgtcgtgaccgtacacggcatcggcccgagcgagagcggcgcgggctacgacgtgtacatggtggaccgcttcaacatccagaagtcgaagcgcaaggacgacgcaggcgatacgttgtgggtcaagccgtacgcggtgcaggaagattgggacttgattacagagcaggtcgtcgagaaggagtacgagctggaagacggcagcggcttcatgtcgatcaagatgacaggcatcgactccggcggtaagtcaggctccacgacgcgcgcctacaactactggcggtcaatgcgtgatagcgccaagggcaaccgagtgctgctcatcaagggcgagccgaagttcggtgccccgcgcgccgagattgactaccccgactcggatcgaaaggatcgctcggccggtgcgcgcggcgaggtgccggtgctgttcttgaactcgaacgtgctgaaggacacgttgctcggcatgctcgacgcgaagaaggacggcggtgctcgctacttcttcaacaagtggacgccggactatgtgtacgtcgagatgacggtggagttccgcgacgacaagaaccgttggttgaacccaggcaagcgacgcaacgaagcatgggatttggcgtactactgcctcggcctctgcaccattctgaaggtcgagcatttcgattgggacaacccggagagctggtacgacgagtggagtaacaactctcttgtgcgacctgccgatcaggaaaagaggtttgcgtcaagcccgactacggattatggtttcggtcaattcggagccaccctgggatgacgcacaatgaccctcgaacagttgcaagccatgcttgcggaggcacaagcggcctatcacaccgccatgatgggcggcgcggtgacggtcgtggtcgaccagaacggggagcgggttgagtacagccgggccaacccggcatccctgctgaagtacatcgccatgctccaggctcagatcaacgccatgctgggggtcgcagtaatcggcggcccccttcgccctctcttttaaggcggcctagaccatgagccaagacctcgcagtagtacgttctccggagggcgatgccgccttccagcgcacgatgaacgacatgattttcggcggtgccttcgagggcgcgaagaacctcaaccgacagaccgcgttgtggtccgcgccctcgctgccgccggacatggaaatcacgccggacaaagtgcgcatggatgcgcgcacccgcgatctgattcgcaacgacggctacatccagggcgcgctcgacacgagcaaggactccatcgtcggcggccagtaccttttgaacgctcggcccgactggcgctcgctcggcttcgacgaaaagtgggccgaagagttccagctcatcgccgagcgcaagttcatgctgtacgccgagtcgccgatgaactggattgacgcctcgcgcaagaacggcctgacgggtctcgtgcgcatggcgctggcccaggcgttcatggcgggcgagacgctggcgacttcggagtacctgaagggcaacggccgtccgtacaagaccgccatcaacatgatcgacccggatcgcctgtcgaatccgaacgacaatagcgacactgcgttcctgcgccgtggcgtggagattgatcgtttcggtgcagcccaggcgtaccacatccgcgacgctcacccgatggaatcctactacgaccgattcggcgcgaagtggacgcgcgttccggcgttcaagccgtggggccgcccgcaggtcatccacatcgccgacatcctgcgccccggtcagacgcgtggtgtttcgcagatggtggcggtgctgaaagaaatgcgcatgacgaaggtctacaaggacatcgttctgcaaaacgcggtggtcaatgcgacctttgctgcggctatcgagtcggagctgccgcgcgagatggtgttcgcgcagctcggctccggcgacatgacgtggttgcagaagtacatgggcgcgctggccgagtacgtgggttcttccgacaacctcgctatcgacggcgtgcgtatcccgcatttgttcccgggcacgaagctcaacctgcaaaacgccggtcagccgggcggcgtcggcagtgacttcgaggactcgctgctgcggcacatctgcgcggcgctgggcctgagctacgagcagttctcgaaggactactcgaagacgaactactcgtcggctcgtgcgtctatgatcgagacgtggaagttcatgcagtcgcgcaagaagctcatcaccgaccgcttcgcgacgatgatctacatgctgtggctggaagaggaaatcaaccgcccggagaccgatctgccgatgccgaagggtgccgcgcatttctacgagggcatcaatcgcgaggcgtacatcaagtgcgactggatcggcgcatcgcgcggccagatcgacgagctgaaggaaacccaggccgccgtgctgcgcatcgcatcgggcctgtcgacgtacgaagacgagctgggcaagctgggcaaggactatcgcgaagtgttcgagcagcacatgcgcgagcagcgcctcatcgagcagaagaagctcaacttcacgatgtcgaccagcaagccgggcacgcagaaggctactgacagcgccgcgaacgatgacgccaaggcggacacggctaccgaaaccgaaacggagaacgacgatgaatgaattgctggcgatgcgcatgtcgatcatggagggcttcaacggccgcccggccctgatcgcaccgcaggagatggagaatatcgcgacgatgttctcgtcgatgatgcttcagcaggccccgccgaccgccgaacagcgcgcggcggctgaagaggcccaggtggtgctcatggagcgtgccttcgacatctcgttcccgcgcgagcgttccaaggcgtttgccttcagcgacggcctcgccttcatcccgatgcgcggcacgctcgtgcatcgtaacggcgactcgtggtacggcacgcgcggctacgacgacattcgtcgcgagttcgacgctgcgatggccgacccggacgtggcgggcatcgtattcgacatccattccggcggcggcatggtctacggcaacttcgagctggccgatcacatccgcagcaagcgcgccgagaagcccaccctgtcggtcgtcaacgcgggcgcgatgtctggcgcgtattcgctgggcagctcggcgaagaagatggtgtcgaccccctccggcgattccggcagcatcggcgtcgtcaccatgcacgtcgatctgagcaaggcgatggagaagttcggcgtcgccatttcgctgatccactccggcgaacacaaggtcgacggaaacccctatagtccgcttcccgacaacgtgcgcgccgacatgcaggtgcgcctggacgggatgtggcagaagttcatttccgtggttgcagctaatcgcggaatgtccgaacaagcgattcgtgacacgcaggcccgcgtctatggcgcggacgatgcggtcaaggtcggcttggtcgatgcggtcatgtctccgcaagaggcagtcgcttccttccgggccgaagtcttcggctcttccaccagcgaaaacaggagtcccaccatgagcgataccaagaagcccgacgccaccgtcgaagagcagaagaagaccgacgccaccgtcgagcagcagaagaagaccgaagagaaggtcgaccacgctgccaacgagcgcgctcgtatcgaaggcatcaccacctgcgaagaagcgaagggccgcgaaggtctcgccaaccacttcgccttcaagagcagcatgagcgtcgacgaagccaaggccgcactcgctgcgtcgccgaaggcgtcggcctccaccggcaagtccgcgctcgacgcggcgatggaaaagaccggcggcggcgctgacatctccaataacggcggcgacggcgaagacgaaggcgacaagggcgagaaggccgatggcggtctgctcggtgcctacgcccacgccaccggcaacaagagcgtgctgaaggccgtcaagtaaagaacaccgtcgccagcctagacgggaaaaaccggctacctagtccactcacaggagtacatcgcaatgaccaactttggccccatcgctggcgtctcggtcgacaacagcaacgccaatggcaacatccagctcttcgctggtgagtccgacatcgttaccacccaggtgcagctcgtgaccggcgtcgcctacgtcggcggtcaggtgctcggccgcgtcaccgcctccggcctgttcgccaagcacgatccggcggcgaccgatggttcgcagaacgcaacccacatcctcggctacgacgttccgacgccgaccgctggcaagtgggaaggtgcgtactcgggcggcgtgttcaacgtcgatgccctgaccttcaacgctgcctccaacaccgtgcagaagaagatcgcggtcttcgacggcacgaacatcgtggcgcagcgcctgtacggcaaccccgccccgaactccggcccggtctaaccggcgattcacccgcaatacgtttcgcacataactcaactgaaacaggagaagcacgatggatttgtatagcactgcggaactgcgcaaggtgatcgtcgacagccggccgcccgtgcagtatttcctcgaccgtctgtacaaggagcagatcaacttcacgaccgaagaaatcatgttcgacgagctgcgtctcggccgtcgcatggctccgttcgtggctccgaacttgcagggtcgcgtcctgaagcgttccggcttctacaccaagaccttccgtccggcctacgtcaagccgaaggatgcggtcaccccgggccgcatgctgcgtcgcttggccggtgaaggtctgaccggcgacatgaccccgggccagcgctggcaggccactgtggccgcgtaccagctcgatcagcgcaaccagatttaccgccgcttcgagtggatgggcgcgcaggccgcgctgtacggtcaggtcaccgtgtcgggcgaagactacccgagcgtgaccatcgacttcggtcgtgccgccaaccacaccgtcatcctgtcgggcaccgccgcgtggagcgactacgacaacagcaacccggacgacgacctggaagattgggccgcgcgtatccgtgaagctgaaggcttcgtggtcactcgcgtcacgatgggcagcaccgcctggaaggcgttccgcaagcacccggccatcaaggagctgctggaaacccgtcgcggctcgaagtcggaagccgagaccggcccgggcctgggcgagagcgtggagtacaagggccagatcggcgcgttcaacatctacgtgtacagcgatgtgtacgaagacgagaccggcaccatgcagccgatgatggacccgcgcgacgtgctgctggaagctgaaggtggcttcgacggcgtgcgtgccttcggcgcgatcatggatgccgacgccggtttgcaggcgctcgacatcttcccgaagatgtggaagaacccggacccgtccgtgatctacctgctgtcgcagtccgcgccgctcatgatcccgagccgtccgaactgcaccctgcgcgcacgcgtcgtcgcgtaaggccgtttcaccagcaacgcccggttcgccgggccgcgctgtttacaccacccaatcaaccccgcaacaggagatgtagaaatggctgacgacaagaagaccaccaaggctgcggccgctggcaagaagctggtcgctcgcgtggcgctgaagggcgacttcgatgccctggatggcctgggcaccgcgatgcaggaaatccaggcgggccaggagttcaccaccgaagacgccaagttgcagaagcagctcgtcgacaacggctacgccaagtcggcgaaggacgcggcgaaggaagaagacgaggctccggccagctctggctccgccccgccgaaggtcgagacgaccgacaagaacgacggcaagaagcagcagtaatcgcgcctgggcgctaggagacggaacatgggctggcttgaaatcaaacaacgcgcgcgtgatgtgacgcacaagacgttcggtatcccagccctgttccgttcggcgggcggcgtgtctacggacacgtccgctcgtttgcactacaaggtgcgcacgtacggcgacctcgaccgcgaaggcttcgcgacgaccgtcgacgatgtggactacgttgtgatcgacactcgcgagctgctggcaaacggcatcgtcgcagaagagggcaaccggattaatttcccgcagctcaacaggactttcaaactcgacgtggagcatccttccgaggacagtcgctacgtcaagtgggcagtaacggagaccgctccatgaccatcggcctgaccatcaacggactcgacgacgtgcgcaagatggtgagcggcataccggaaacggtcgaccgcgcatcggctgttgcgatcaacgaagcgatcacgttcggtcaggccgagagcagccgtcgcattcgcgagcaggttgcgttcaaggcgagctacatcggcaacgcgaccgatccgggcgcgagactgcgtgtagcgaagaaggcccgcgtaggcgacctcgtaggcgtcatctccggtcgtcaccggccgacctctctggctcagttcgagcagggcgcgaagctcggcaaaggcggctacgttcgagtcaaggtttccgcgaccggcggatcgaagcgcatccccggcgcatttccgatcaagctgcggcgcggcaacggcgtgtacgacgccgagaactcgaacgaaggtattgcggtgcggctcaacaagcagggagagctgcccggcggcttgaacaagaagcaggcggtcaacgtgagcggaagcctctacctgttgtatggtccgtccgtcgatcaagtatttcgtgatgttcggttcgatgtgcaaggcccggtgggtgacgcactcgaatcgagcttcctccgcaacttcgggagattgaaccgtggctgatacgaagcgactgttgctggtcaagacgctctgcgattacctgaagagcgaaatcaccctggcgaacggctacaacttcgacctcgcgatggttcgtcgtgacaagcgcaacttcggcaaggagatgaagctgccgggcgtggcggtgctggaaaacttcaaccccgaccgcttgccggaaactatcggcgggttcgtcgggcagaagcacaagtacgatcagatttacctgctcaacggctgggctgacaactcaggactggccgagggcgacgatgagacggatgcggcacatctgctcatgggcgacgtaaaaaaggcgctggggaagttgattaccccgcgcaaccaagacgggttcttcggtggtctcgcaaacacgctgtccatcgaacccggggttgttcggcctcccgacgagcaatccgacaaagcgtacttctggatgagggtccgaatggaactcgtcgagaaggtgggagacccgtactggattcgtgattaacccctgcaacaccacccgaaggagaccacaatgggcagcgagaattacacccttggccgtggcgaactgcgtttcgacaagttcgtaccgggcacccgcaacaagaccggcgagcgttacctgggcaacaccccggaactgaacctcaccaccgagagcgaaaacctcgatcacttcaacagtgaccggggcattcgcacgaaggacaagagcatcgttctggaaaagaccgacagcggcaccttcatcgccgacgaaatcagcgatgacaacgtggccctgtggttcctgggcgacgtgagcgtcgtggcgcaggcggccctcaccgcgcaggtccaggtggttccggccaaccgcgtcaagccgggcacctacatccagatcggcgagtcgctggcgaacccgaccggcgtgcgcaacgtgaccatcaccagcgtcaccgatggcgcgggcacccccgtcccgtacacgctcaacgaggactacaccgtcgactccgagctgggccagctctacgtggtcccgggcggcgctatcgacggcaccgaggcgttcaccatcaactacagcgcggccgcctcgacccgctcgcaggtcgtggtcggcgacggcaccaccgtggaaggcgcgctgcgcttcgtctcctacaacccgaccggcccgcgccgcgactacctgtggccctacgtgcagctccgcgcggacggcgatctggccctgaagggcgacgaatggcagcagctcagcttcgcgttcgacatcctgaagctggacggctacgctaccgtctacatcgacggccgtccccaggtggcgtaaccggggcgcgtcaaacgcggtcaaggccaacttagtcaagaccaagaaggccaagaccaacttcgacaggccgctctccgaaagggggcggcctgttttcttgccagcaaccgaggaagccaatgtccctttcgtcccttcgccttcgcaccatcaccgtcccgtacctgggcgcggatgacgagcagcagagcatcgtgctgttcggcctcaacgccaacgacgtggccggaatcatcatcgcgcagaaagacaacatggaagaaatcttcgacatcgttgaaggtgccggtgtcaagaaagccaccgacctcgctgaagtcgacatgatgcagatcggccagaagctcatggtgcagatgccggacttcatcgcacgcgttatcgcgtacgccgcgcacgagccggaagcgtggatggtcgccatgcagctcgacgcgccgacgcagatcaagtgcatgcgcgccatcgccgaacttaccttcaaggacgaggccggattccgcgagttcctgggaaacgtccaagcggcacttcgcggagcaaaaagcgtggtgccgcacctgcgaaacaaaaatctcgaatcgagcgattcgcagggtggtggctcggaatccgagcagcagtctccttcctgaccgctgaaggacacgctctcgcaggcgagtatccgctgggtgtgttgatcgtagaaacggaactcgcgcgcgagcgtgtcaacaaccgcattagaactgaagcggttttgattcaaagcgcaatcggctccgcgctcagcaagaagggcgcgcaggcattcaaggaacaaatctcggagctataggcgatggccgctcagaacgaagttgaactgatcgtacgtgcgaagaacctcagtacgaaaaccatttctcagctcaatgacgagctgggcaaagtcgccgaaaaccaaaacgaagtagccgatgcgaaccgtctcgccgagcggtcgttcgagagtctgaagggcgagcagcagaagttgctcgctatcatgaagtcgctcaacgaccgctcgcgcaagctggaaggctacgctcagcaagagcagcaggtgcgcagcctccgcgaagaactcgcgcgtgctcgcgaaaacctcaacacgctcgcgcagcagtattacaacaccgagaagccgacgaaggagttcacccagcagttgaaggccgctggcagtgaagtcactcgcctggacgcgtcgctgcggaataacgagcgccgcctggaaacgtcgggcgcgaagctgaaggagatgggcgtcgacacgacccgcttcagccagtcgcagcaggaactcaacagtgcggtcaacaactcgctggcgctgtaccggcagtcgaccgacaacatggagcgctacgacaccgctgtccgcgaagtgcggcagcagcaggaactcgcgcagcaggaagaacggcagcaggcgcaggccgcccgcgattcggccgctgctgttgcccaggccgcgaaggaccgcgaagagcaggcccggaaggagcagcgcttcgtcgagctgaccaccaacgtctaccgcaccctggcccgcgagaaggagaaggcggcggccgccggggcgaacttccgcgccaccggcacgcaggctgcgcaggcggcccgcgctaccgccgcccctgccgtgggtagcgggtcgaccctgggcggggcagcagcgggcgtacaggcggtgctggaaccggccaagcaggcggtcgctacgctcgaccagctcgaaaaggccgtcgaccagctcgacaaggagttcgaggccctgacgccggacgccctgaaggccgctgacggcatcgagaagctggccgaccagagccgccgcctgcgggaagcggccgccgcgctgaagggccaaggcggtctcgccgatgacctcgcgcggcagaacacggccttgaccgccagccagcagcggttcgaggaagcgcgccaggaagtgctgcgctacgccgaagccgtggagcgatcggatcgcccgaacgacgagctggcggcgtcgctgcaacgcgcacaggccgcactgcggcaggcccaggcagacctgggtcgacagaccgaagcgttcaaccgcgtgcagcagcgtgcggcggccgcaggcatcaccctggaaaacctcaacggcatcgagcagcgcctcgctcagaacgccactcgcgttgcgaacggccagaagcaggtcgcgcagacgatgacgcagttggagcagtcgaccgcgaagaccagcaagcagctcaacgcgctcaacaccgggcagcgcaccgcgctgtcgctgtatcagcgtacccgtggtcaggtgctctcgctggtgtctgcctacgtgggcgtgttcggcgcgatcaatctggtgaaccaaagcgtcgacgccgccgtggatcgcgagcgcgcaatgtcgcgtctcatgatcgcaaacaagggcgacgccaacgcggcggcgaaggaatacgactatctgcgcaagaaggctgacgagctgggcctcgccttcggcccgttggcggattcgtacagccggttctcggttgctgcgcgcgatgccggtatgtcggcggaagcaacgcgttatatcttcgagtcgttcacggaagcggcgacggtcctgcgcctgagtggcgaagagactgagggcgcgttccgcgccttggagcagattttctcgaagggctacatccaggcagaagagcttcgcggccagctcggcgaccgcatgaccggcgcgttcaatttgttcgcgaaggctatcggcgtgtcgacgcaagagctgaataagatgctcgaaaagggcggcgaggttaaggcggagttcgtgctgctggcggcgcaaactgcgcgcggtatttatggtccgcaggccaaggccgcatcgaacagcttgctcggcgacattaaccgcatgtcgaacgcgtggggcgatctgaagcgtgaaatcatcgacggcggcctcggtactgcgctgcgcagcctgttcgtcgatctgacgaagttcctgaagagcgacgacggtaagaagttcgctgcgaatctgacgaaggtcttcgtcgcggccgctgaagcgggcaaggagctgatcgacgtattcgccgagtacgacggcctgatcgagaccgtagcgaacaccgtcgccttcctcgtgcggaacttcaaggagctgatcgcgatcatgctggcgatccaggcagcgcgcatcgccatcgtcttcactcagctcgctacggaaatcctgaaggcccgtgcagccacggtcgcgctcaacacggcgctcggtgcgggcacggccgcgtctgccggtcgcgcaggcgcttcgctgctggcgctgatcggcggccccatcgcggcgctgctggcaatcgcttcggcgggcgtcatcatcccgatctatttccagatgaagggcgagctgaagtcgaacaacgacaagctcgatgtgcagaagaccgtcacggaactcaaccgtggttttgcggcgtccgagcgaaacctcgcagttctgtcgcgcgacaacaccgagcagttggaaaagcgcgtgcaggcagcgcagcgcttgctcacgatctacgatgagcagaagaagaacctcgccgatcagatcgcgcagaacacgaccatccgcaagaatcaggtcgcgattcgcactgcgcagagcactcgggaaggcgacgccaatctgccgtcgaagcagttcgaggctatccggcaggtcgaggccgagggcaaggcgatggaggcgcagctcgccaacctcgaacgccgtgcggccccgctgcgcgagctggtcgcatcggccagccgtgacctcggcatcgcgaagtcgaaggcggccgcgaccgagaacgatgcgctgtcggccgagttcaagcgcatccaggccgaggcggacgcagcggcaaagcgtgcgggcacggacaccaaggcagcgaaggcggccgaagcggcgcgcaagaagaaggaggccgaagagaagcgcctcgccgccctggccgagcgccgtgtgcgcctggaagaagacgtggccgagaagctgcgcgacatcgacagcgacatcgcccaggcgcgcccggatacgctggaagaccggctgaaggtgatcgacaacaagatcgctgatcgcaaggcagagttggagcgcatgatccgcgaggcggaaaagctaaacgtgcccgatgcgaagaaggaagcgcagcgcggcctggacgcactgccggacctcgaaaagcagcagaagcagttggccgagcaggagttctacgaggctcgcatcaacaccctgttgcagcagcgcagcacgtccatcgacacgatcaacaccttgcaggaagccggtctgctgacggcaagcgaagcgtccgcgcagatggaagaggtcaacgctcgtctgctgccgcagctcgaagctctgcgactgaaggcggtcgagttcatggctacgctgggcgatggcccacaggcccaggctgctcgcgcgaacctcgaaaacctcaatgcgcagatcaaggcgatgtcggtcgagatgtcggcgactaagcggaagatcgtcgacgtgttcaccaacggcttcacgaacgccttcatggagagcgcggcggtgatgtccgactacctgaagggcatccagagtgcgggcgacgcatggaagagcttcggcgacatcgtgctcaacaccatcgccgacattctcgtgcagctcgcgcagatgattatccagcaggccatcttcaacgcgctgaagcaggcttcggagagcgcgagcggcggctggggcgcgatcatcaacgcggcgatgagctacgtgaagcatgacggcggtgtggtcggcgcggcgtcgaagaagcgtgcggtgccgagctacgtctacgagagcgcggtgcgctaccacacgggcggcgtggcgggcttcgcggccgacgaagtaccggcggtgctgaagaagaacgaagaggtcttgaccgaaaacgatccgcgccaccgcttcaacggcggcatggctggcggcagcggcccggccccggtagacctgtctatcatcaacaccatcgacagcgagagcgtggttgcggccggtgctaacacccgcgctggtcgtcaggcgatcttcaacgtcatcaaggctgaccgagcctccttcaagaaactcctgggcaattaaaggaaccaacatgggacacgcaatcggaactgttacgggcggcagcggcgacgaggcgtactacaaggtactcgctgcgatcaagaccctggctgaagcgaacggatggacgacgctgcgctacgtcaacacaggcacgaaccgcgagctgattttgaactcgaagggcttgtcgggaacggaggacatctacatcggcttccgtacctacttcagcacgagcggcgactactacaatatcctcgtgggcgtgttcaccggcttcgtatcggctaacacgttcgacgctcagccgggcgcgcggctttctggcgtgccgtgccataacaacgccgtcacctacttcatcactgccaacgcccagcgcatcgccggttgcttcaaagtcggcacgccggtctacacgcacttctatgcaggcaagatgttcccgtattcccgccccggcgagttcccctcgccgctggtgtgcgcgggcatgttcgacggcgcagcggcgaagcgattctcggacctcgactacgcgttcccgtatcacggtcgtgagagcggcgcgtcttccccggagcgtccttcgctgctgtggctgcgcgatcaggtaggcacgtggcgtcgcctctcgcatttcccgttctataacggcgcggctggctcgaactcgtggaacggctacaacgcgttggcgaactacagctacttggacacggacgtaagccaccgctccctggtcccggcaggaacgaactaccagccgcagccgatcatcctgtacaccaccacggccagcggcgacacctacgcgggaaatgtcttcggcgagctggacggcgtgtaccagatttccggcttcaacaacaacgtggagaacgtggtgcaggtcggcggcactgcggtggacagcaccggcatgaccgtggctgagcacgtcgatgcagtccttgcggcgggcggccgcgcattcgtgatgctgcaagacgtgggtcgaaccgactggcgcagcttcatcggcttggagatgacctaatgttctacaccggcaatttttcttcgttcgtgacgctgaaggcgtcgatggaagcggcgcttcagaaccacggctgggcgctcaacggcgacggcacgctggaaaagaacggcatgtacgtccgcctcgtggcgaccgacatctaccagatcgcagcgttcgcaggcaccggcagcgccgtcgacccgttccctctgccgggcgcggctccgtacggcgtgaaaatcatgaacttcagcggctcgccgatgaacttcccggcgacctatgacctgcacgtgttcgaggaaaccgatgaggtctacctcgtcatcaattacaacggcgacaagtaccagcagttgtcgttcggcaagtctcgcgtcgatcaggtcggcggcaccggcatgtggctcaccggttcgttccgcagtgacgtggtgcaggcggcaacccatctcgtgtacaccaacgcgtcggatagctacgtcggcttcgggtggagcggcatggggtgtggcttgttccacgaggtatacaacgcgcccctgggctgctcctacatccacactggcctggactcaaccgggtggaagcgcgtagggaccagcgaaggtgatttgatgggcagcggcgatccagttgccgctctgctgcaatcgctgccgtcgcagttcaaccagagcaccgtgctcctgccgttgctcgcggtgcagcgtcgtctctcgaaggggcagactatcgccgcagacctgcaaaacgcgcgcctgtgtcgcaacgacaaccacctgtccggcgaaatcgtgacctacggcaccgaccgctggaaggtgtacccgttccaccgtaagaacgcagcagtgcgcaacggcgtgccgtggtcgaccggcgcggatcacagcggcacgtttgcctacgccattcgctacacggggccgtgacatggcagcacgtatcggacaaatggggagcgcgtttgagcggggcatcgacaacccgatgctcagtgatgacctcaacaaactgactgaagtcgtgtcgatgttcgacagctacgacggcggtcgcttcttgcagggccgctacggtagctggcacgtgcattcgagcaaccaccggggtgtgtcggcgcagcgcaagatgacgagcttcttcgacgactactacaaccgcatcttcatcgtcccggccgccctggatgcgggcaatctgctgtccacgcaggtccggcacatcatcctttggaatgcctacgtcacgccgcagacgttggagtcggccgtgctcggcccgcaggcaggcatttcgatgtctcccccggcgggcgtcagcattccgttcgagatgccgccgctgcgtgagctggatttcaccgttcagatcgaactggcaggcccgccgacgatcagcagctatgcgcgcttcaccgtggaaggcgtcaactacaccgtgccgatcaccggccgccgcatcgttctcttcccgttctctccgaattgggggtctccggtcgacgagacgatcacgcatcgctcgtgggtgctgtcgtcggacgacggtagcgagcagaccggtagcgagtcgggtgaagtgccgcgacgcacgttggagttcaacatcaatctgcggacttctaagcaggcccagcgcgccgagaatctgctgttcgcatggcaggcccgcttcttcggcgtcccgcattggggcgaagagtcgcgtaccgacgcagccgtcgaagcgggctcgctcgttatccccttcaacaccttcggcctgtcgctcgaacccggttcgctggtggcgctgtatctcgacgacgaggtgaacgaaatccgcgaagtgcagcaggtcactgctgacggcgtttcggtcacgaccgggttggagtacgactggcctgccgactcgcgcgtgtatccgtgtttcgttggcctcatgagcgaagagatgtccgagcagcgcgagacttcccgcgttggccgcatggcgatgtcgttcgacttcgagccgagcgtaacgccgggcaacgcggcgatgaacccggacccgatgacctaccgagggcacgagctgtacatcaaggagaccaactggctgtcggcgatgcctttctccttcagcgcggacacgaagcgcgtagacaccggcacaggcaagttcgttgccttcaccacctcgggcttctcgaaaatcagccgccgccataactggacgctgttcgaccgcgctgacattttcgagttccgtcgtttcctcggccgtcgccagggtgttgctcgttcggtctacatgccgagcggcaccgaagatttcacgatggcggcgacgatcctcgacaccgagaactcgctcgtggtggagtcgaacgaatacgcgaagctggtcggtgcgcatcctgctcgccgcgacatcttcatcctgttgaagaatggtcggtatttctgtcgtcgcattacgctggttagcgagttcgacaacctgacccggttgcagctcgacagtgcgctcggcgaagaggtgcggccgcaggatattcgtcggatcagttttttgacgctgtaccgcttccagtctccttccaccacggtgcgctacctgaccgattccaaggccaccgtcgagtcgatgctggtcgccaagatgaccgaggactgatatgtctctggcccaatacgaaagcagcaaagaacaaggctctcgcgtggagctttacctgtttgagagcgacgacggccgttaccgctgggcgtacaccaccgatgcgcgggagcgctcgattggcccgattacttacaggcccgaagcgattaaacgcggcgagctgaagcagaccgcaggcgatgccaacgtcgagagcctggaagtcgtcgtgccgttcgacaaccccgtggcggccgcgcacgtgccgtatctgccgcctcgccctatcaagctgacgatctacgcgtaccagcgcaatgaccccggcgcggaaatcgtgcaggcgttcaccggcttcgtgacgagcttcagccagaagggagctgacgcgacgctgcaatgctcgcagatcatcgacaacctttcgcagacggtgccgtgggtggtgttcaaggtcggttgcgtgtgggcgctgtaccagatcggttgcggcgtcgacaagtcgctgtggcggcgtgatgcgctcatcaccaccgtggacggctacacgctcggctcgcctgagttcgcgtccaagccgaccggctactacaccaacggcttcatcgtcgaccgcgagaccggcgagcagcgtttcatcacggcgcatgacgcagccaccgccacgatcaaggtcgtgtatccgttccaaacggtgcagggcgggcagattctcgacgtgtacgcaggctgcgcacgcacgaaggaagtctgctcgggcaagttcaataacaagatcaactacgtcgggttcgatcacttcccgacctacaacgtcttccagcaggggatcacctaatggcctggatcgcaattatcgtcgcaatcgtcgtcgcaatcgtcggcgagctgctgcggccgaagcagaagttcaacgacccgaacccatcggccgtgggcgacttcaagttccccaccgtggacgcctcgcgcgtcgtaccggtgtggtggggcacctgcaagatgatggggccgaatgtggtgtggttcggcgacctcgaagtcgtgacgctgaagaagaaggtcaagaccggctggttctcgtcgaagaagatcgtcaccgggtacaactactacctgggcgtgcagctcgtgttcggctacggcccggcagacgagttcatcgaactgcgcgtagacgacaaggtggctgaccttgtgcgctcggtgttcaagtacaaggacacgtggctggccggtcaggtcgcgagcaaggagttcgtcggcgacaagtgcgagttctacatctgctcgccgtccattctcgacaacggcgacccgccgagcggcgtagttggcaagtgcgttctgtaccaaggcacgttcacgcagggcacgaacaactacctctccggccagtggaacgaaccggacatgtccgcgttccgcccgttggtgcatatggtcatggagaagtgctacctcggcaacagcgacacgccgccgcccatctcgatcattgctcgccgctgcccgaaccagctcggcctgaccggcggccgccacaacgtcaacggcgacgcgaatatcgcgtgcgcgtcgtatgagttgatgaccaacaacatgtggggcatgaaaatccctgaagacaagatcgacgttgactcgttccgcgcttgcggcaacctgctggctgaagagtcgctgggcatttcgatgctggtgcagtcggccatgctcggcaaagacctcctggccgaagtgctgcgccacgctgacgccgtggtgtacgccgatccggtcaccggcctgtacacgatgacgctggcccgtgagttctcgcaggccgagaaggacgacctgctggttattgacgacagcaatatcctcgaagacagcttcgacttctcgcgcacgtcctgggagatgacgaagaatacgatcatcgttgagtacaccgaccgcgcctcgttcgagaccaagccggtgcagtaccaagacctcgccaacatcgacgtgcgcggcggcatgatcgacgcggagaccttcagctacctcggcttcagcaatgacactgcggcgatgaacaccgctgctcgcgtgtcgaaaatgaaagcgtcgccgctggtctcggcgaagatgtcgctcaaccgcatcggctacaagctgcgtcccggctccggcttctggctgcgcaagccggatcgcggactggcgaacgtgctcatgcgcgtgatcgaaatcagctacggcaccctggacgacccggcgatcaagatcaccgcgatggaggacatcttcgaggtcaacgctgtagcgtacgtgccgccgggtccgggtgattgggttccgccggttactgctctcgcaccgttcgctgcgcagcgcgtgatcgaagccccggcattcggcgctgacgatatgagccgacgctttctcatcacgatgggcgtgcccgcgagcaacggcgtcatcggctacgacgtgtggagcgaccccagcggcgcgtcgaattaccagatcaccaacgtggtcgagggctacacgccgtctgctgttctcttggccggtctgtcgcgcactggcccggaagtcgacaccgcaggcttcaccgtgtcgtcggccatcgggctgaccggtcttgacccaggcaccgatggttcgcgagaggcaggcgagaacctgctgctggtcggcaacgaactcatggcatggaagaacatcgtcgacaacggcaacggcacgttcacgatcaccggggtgtaccgcgctgtgctcgacaccatcccgcaggatcacgctaccggcgcacgcgtgttcttcctgtccgaaggtgcgggcacgaccaacgtcgacggctactcgggcaacgtcacggtcaacacgaagctagctccgaagaacgtgtcgtcgtcgctcgacatcaacctcgcagcagccgtcacggtcacgaccaactcgcgctctctgcggccgctgccgccgggccgaatccgggtcaacgccgcgccggtcggtgctggatcggccttcaccggggacatgatcttgacctgggcgcaccgcaaccgcctggacgggactatcgcctcccaggccgatccgtcacgtacgccggaggaagggacgacctacaacatccgggtctacaccggctcgaacgccctactggcagaagcgcttgcggtctccgacgctgctaccgccgcgaccatccgcctcgcagtagcaggagacatgcgcatcgaaatcgagtcgatgcgggagggcctggcctcgtggtcgaagcaggtggcctacttcagctacactccggccagcggcacgatcacgaacaccatcgcggtcgacgagccggagtacgttcttgacggaggcggcgcgtaatggcccaggtagttgttgcccaacgcatgtggcagcgccgcgacgtagcggcgaactggcaatcgaagaacccggtcctcgcggccggggaaatcggcgtgcagctcggtgcgacttcggacgagaccaagttcaagatcggcgacggcgtgacgccctggaacagcatcggtttcttcgaggggcggctgatcgaaatcggtacgggcggcggctacatccgctggcgctacgtcggtgacgagaactggatcaacctcgtgtcgctcgaatccctgcgcggcccgcaaggcaacgcaggcgcaaccggcgcgaacggcctgagcgcgtatcaggtggcggtggcgaacggattcgccggtacgcaagctgagtggctggcgtcgttgaaaggcgcgaagggtgaccccggtatccaggggccgcccggcatcccatcgcagcgtcgcatccagagaatcactgacaccaccagcggctcggtcatctgcgactggaactcgtacgacgaaatccgagtgacgctcacggccaacacgcagatcaacatggaaggtgctctggacggccagggttgcgttctgttgctgaagcaagacgctgttggcggccgtgcggttaccttcagcaacaatgttcgattcaacaacctcatctcgacctacaacgccacttccacgccgggaaagtctgaccgcatcggtttcgtgtacgacgatgacgacggcttctacgatgtgcaggccgtggtggatggaatctgacgatggccgacgaatacaccccgccgctatcgcccaacatcgtttgggtgttcaagggcaacgagtacaacccgccgctgtcgcccaacatcgagtggattttcggtgctgacgatgacggaggtggcaacgagttgcgcaagtcttcctacatgcttctcttgactatgtgaggttctgaaatgactgttcgagtttattcctcttctgacgcagacgctccggtccttcgcggcaatacgcccggcgacctcatcaacgtgctcgaaaagtgcctcgtcaccggctacggcagcaaggcgggcgcgggctggacgaagccgttcgctggcaccaacgtggccgcattcaagcaaggccctggctccaatggcatgtacctgcgcgtggacgacaccagcaccgccaccagctaccgtaaggcgaaggtcgtcggctacgaggtcatgaccgatgtcaacaccggctcgccgtcgcccttcccgactctcgcgcagaacccgcagggcggcaattggttcacccactacagtagcggctcggtggcgaacccccgcccgtggacgattatcgcagacgagatgttcttctggttgttgctgaccacttacccggagagcggcacgcagtattaccgcgagtgctacgcgttcggcgacatcatcccgttcaagccgggcgacaccacgcacaccatcctgttgcagaacgactcgcccgacagccccaactcttcggagcagtatccgttccagggttacagcatttcttcggcgatgaaccgctaccgcctttcggttgcgcgtgacttcaccaacctgggcggcccgatcacgctcggctggcacaacgatatgaccaagggcaacagcagttggggcaacggtaacctcagctatcctcacggccctgacggcgggctgtacctctctccggtgtgggcgcacaacccgaatgtcggaccctacagtattcgcgggatcatgcccggcatttgggttcactgccactacttcggaatcctgcccgatggcgcgttggtcgaaggccagggcgaactggcagggaaacagttcctccatcgggtgcactaccagaactccgcgttgtttgaaatctccgacacctgggatcggtaaactgaaatgctgctcgccaacctacccctaagctcgccggaaggatcgacttcgtacgcagacgctacaggtcgattttggagcggctacagcgtcgctccgatcatcatcgacggagcggcgcgttttataggcgacggtctgatctacacgaacagcggcggcgatttcctgctcggcacgaaagatttcgacatcgctttcgacatccagactacgagcagtacgctctccaccgttctagactacctgaccggcagcggaagcacgtggcaggtgtatttcagcaccgaggggcgtttgatctggacggcggaaggccccaacgaatcgccggtaatcggtacgacgagcgcggttaacgatggcaactggcacaccgtgctgttccgtcgaagggacggtgtgctgagcgttttggtggacggcgcagtggaagcgtcggtgcctcacgcccgcaactacaactacgcggtcagcacgtttgcaatcggcggtcgtttgtacttgggcttctcgtatattttcaggggcggcattcgcaacgtctacatcaacgtcatcgacccgccgcctgcacccgcacgcctcgccgcgttcattcgccgcagccgcatcggctgggacaaagtaaccaaggttgattcggtcaagaagatcgaggtctatcgcgcgcctccggccagtttgcggaaggtgcagaccaccaagtcgacgcgaggtgtcccgccatggtggggcgctccggggtcgaccaacgtgctgccgacgtacaagctgcgcggccgcgtgatgcagcgagacccggatacgcaagaagacacgccgttgcagaacgtgcgcgtcgctttgttctaccgccgcctgcatacgctgatcgacatccagctctcggatgcgaacggctacgtgcagttcaacaacctcatgcccggcgtccaggcgtactacggaatcgccttcgactcggacggcggcatcatgcagaactcggtactgtgggatcgcctcacgtccgaacccggcccttaattaatcaggagaagcaccatgaccgactcgaagaagctcaccgacgctgacatcgcacgcgcagccaaggcccttgttgtatcccaggcgaaggtgcgcgccattctcgatgtcgaagcgccacgcggcgggtttcaggacgacgggcaggtcacgatcctgttcgagccgcacaagttctcggagtacacgggcggccgcttcgacaagagccacccgcacctgagcaatccggtgtggggcgcggttccctacagcagctacgccagccagcacggcaaactgcaacaggccgtggcgctcgaccgcgacgccgcactgcgcgcaacgagctggggcatcccgcaaatcctgggcaacaactggaagaaagtcggagcggcatcgttgcaggatttcatcaaccgcatgttccgcagcgagggcgcgcagctcgacctcatggtggcgttcatccagagtgacaccgagttgtggaatgctttgaagcgcggcgattgggccaccgtcgcgagaaagtacaacggctcgcagtaccgcaagaaccaatacgacgtgaaacttgcagcagcccatagaaaattcggaggaaactgagatggaaatcaaaccgcgaatcggtgccgacttgtggcacgccatcacccaaggcacgacgctgaaggtgcgtttcattctcgccctgcaaagcctcatcttcggcgcgagtttgctggtccggcccatgcccgccccgacccggtgggcgctgttcgccacgctgccggtctacgcatggtcggcaatgctatggctcagcgggtcgctcatgctgtggcgcgtgctctccacgcggccggtgacgtggctggcttgggcctccaacgtgttcgcgctgttcacttggtttatcatctgcctgtcctatgccgccttcgagggctggcggggcttggttggcacgcacatcctggccctggtcatggctgttttctgcgtgctccgtactgaggcgactcgtagcgatctggaaacagcgtgatggacgttgagctggaagctgcggtcgacaacatgacaggggaattgacggtggatgaaacgaacgcctggaagtgggtggcggcactgctaggaacgctggtgaccggcggcgtcggttgggtcatcaagaggcagcgctcgggccagattctcgacgacaccgagaacgcggccaagactgatttgatcgagcggttgcagaagcggaaccgggagctggaagaacaactcggtgagcttttcaacaaaaccgccgccgggtacaacgaaatcggcgaagccaagcgcgcggccaacatggcgagcatcgaagctgacactgcaaaagccgctgccgcacgcgcatcggaagcagcgtcccacgcgcaaaggatggcgcaggcggccgacgacgtttcagcgaaacgactggtctacatccacgagctgcgtgcgttgctcgtcgccaacaacatcccgttgcccgcgtggccggagggggttctatgagctggttgttgaacacgaggctgggccaggggttgatcctggccgtggtgattctgctctgctggtggggcttcgcctcgcactacgaacagaaggggcgtgacgcatgcaaggccgagggcaacacgcagtacatcaagaccgaggcgaagggccgcgacgtggcccagcaggcggacaaggaagccgcggcggtcgagcagcaggccggacagacgaaggtcgagaccgtcgagaccatccgaaccgtctaccgcgaccggatcgtcaccaagccggtcagccccggtagctgcgtccacccggtcgacccggcggtgcaggccgagctgctggcccgctggaaggacgcgaacgggggtgtgccatgaccgcccgcgccctggtgctggcggccgccctggtggccctgtgcggctgcacgcaggccgttcgcccggcaccgcctaccgtggactgccgacaggccgcctcgacgcccctggaccccctaccggcggctgacgagtgggtggagtgggtgccgcccacccccgaacggcccaacggcctcgcccggctgtccgcacgggccgccgagtgggttgccagtacgctggtagcggtgaagcgggaacgcgccctggcggccgtgcaggagcgttgcctggacgggtacgagaaggcgggggcgatccgccggtagttgacagccccggcggtcggggatagctttagggccgctggtcgcacttcgcgttgcatcggcacctcggtagggaacgcaggaagagaatcggcgctcagcctgcaactggaaaccccggactaaacacccggggttttcttttgcggtcaaggccaagttggtcttgccccggttggtcttgaccgcaaaagaaaggccccgttgctgagacggggccttccgggggtggcgcgactctcgtcggtggccgggtgtcgactgcgtggttctgctgattccggttttcgctatgcgctggtccggctggaagggcaatatcgcttcgacgactcgaccataaggccgcgtgggtcagcgtgtcaagcgtccgtcgatcacctgttccaacttgccgcccaggtgttgcagcgcctccaccatctcgcgccactcgaacatgtgccgcgtgcggaacgtaccgaacgcatacaccgtgatgccgtcccagcggcggccccggatgtcgttgaggctcgctacccgcttccactcgccgcgcgatgcgcctttgatgtcggcgcactgttcggcctgtctgtcgtctccggcgatgatgtagatcatggcttaccccttgaacttctcgacgtgcttcagcattttctcgcgcgtctccttcagtccatcgtcccacgtcttccaagccgccgcgtcgatgtggctcaggatttcgtcgcgggccatgttgctcagcacggtgggcggcagagcgtccagctcccagctcgattcgccaaatcgcttgcggtaattcacgaaacgcgagtccgtggtttttgccgggttcggcggcggcttcaactcttcgatctggtcgtagttcaacgccatgcgcttcaactcgaactcgccgcccaggccgaacaactggaagcgttcgatcaggtcgcgcgtcatgtcgatgccgctcgggtcgtggtcgccgaagtgcaggatcagcacgtccttgtcggcgttgtgttcgatttcccgccgcgcgaaatcacgcacaaccgatgcgctcgggtagccgcgcgccgcgagcagcggcacatcgtaattccagcacacgttttggaacacgccgaccagtgcttccttctcgactacaaggaaaatgcggcggtcctgcgcggcccacgggtcggtgtggtactgcttggcgctggccgtcaggatgtccttcgggttattccaacgcccgcgcgcctcgaacgaacgcgtgcggtcttcgatggcgtcccaatcaaccagaccggcgatgcggccatcgttgacgaggcgggtgatgtacttataggacttctcgttgttcggaatgatgtcgcgggcaacgagctggtagtaaagctggcgcactgtcagcgtgtagccttcgtcctgatagacctcaatgatgccgttgatgcggtcgatcatttcgaggctcttcttcttgaacgtgatttcctgatacatctcgcgcatggcactcggctccggttgttacagcatgatgctcatggaatcgttgaaggtgatcgtgcgctcgtcatcggcacagcgcgtctcttccttcttgatgttcagcgtttcgctgccccgcacgcacacgaagccgtccttagtgacgttgcagaacccggcgctgtggacttcgacctcgacgttggccggtcgaagctcgatggtgacgtgccgcttcatcgccttggcgatttccgagtgggtcaggtgctcggagaagatgaaggggaacgccttgctcacgtccatgtcggcgaacgtggccttcaggatgacgtacttcatacgccgcctcgcttgcggatcgcggtcgcgctgatcgactcgatttcttcagtgaggcgaatctgctcgaccttgtagccgacatcgcgcccgtagtacacgccgttgacgttcggcatcgggaacacgtggaagcagccccggcggtgctgaagcgcggcttcgatacgcgtggtgaccgctacgccgtccagcgggttgctcgggccgttcggcatgaagcgcacgccgatgccgacgtagccttccttcgcgagcacctgctcgaacagcgccgcgtggcctgcgtgccacggctggtagcgaccgatcatgagaccctgggggatcatgaagcggatcgcctcggcgatgtgacccatctcggtcgtgtccgcccaacgttcggtcacgtagtccgcgttctccggcggcacgaacatctcgttggtgtccgggtagcggctctcggcaagggtgttcatgaagacggtcaagtccgctccgaacaccgcgcgaatctccggcgtcggcgcaacgaagtcagacacaaccagaccttcgtgcgtgtcggcaacagcgcgcatgcggtgcgcctgctccatgcggccttccagcgtgaagtcccaattgttcgccgcctcgcgcacggcatcgccgttgacgtgagcggcgttgaggcgcgcggcgagttcccgcgcgaaggtcgacttgcccgagccgggcaggccgcagatcagaatacgcttagccattgtgctgttccttttcgatgcgaagttcttcgcggatttccatgagcagtttgccgagatggttctcgcccttcccgtcgcacacgccccaatacttgtcgccccaccaattgccttcgacgagggttgcgttgccggtcttcagcagcttcgacttcagcggctcggtgccgaacttctggcggagcagctttctcatgacgttgatcttgttctcttcccatccgtcgcgcagcactacgcgcttaccgcgccgcttcgcgcctgcggcgtccggctcgttacggatgcgtcgacgttcgtccatgtcgtcggtctttgcagcctggaacgcgtgctcgaccgtccggtaggagtggccgtcgaaaacgacagcgcacgaccagaagttcgagaggaagcgatacgggcctgcgaagctgccgatggttttcatggtgcctcctagtggatgatcttggccttgccgaacaggatgcgctgcttctggatgtcagtgcgccggatttgttcttcgagcgagacctgcacgttggtcttcatcatcgcgtgcaggtggcgcggctctacgaccttcccggtgacgaacttgtagatggccgagagcagcgacgggttatgcagctcgaagaaactgccggtaagcacccaggggttgtgacggatgctgctggcgatttcgatgagctgcttctcggcctttcgcagatcgagcggcggcgtgatgcccagggtctccatgctgtgcgccacttcgcgcgcaggccgatggacgatcaggaactttgcgccagggaaccgcacgacgagatggtcgaaaaagaacatcgcggccacgtcggagatgaaagccgggccgggcggcatgccgtcaacaaccaggcccagctcgttgatagacgcgcactgctgcaacgggttgtgcagagacgcgcagccgtggccggtgcccgggcggacgaacgcttccatccacgcgctgcgactgcgcggcaggctcagcatgatcgtcaggtcgtggtactcacccatcggcgttctccttcagccgcgcttcgagcaaatcgcgcatggccgatgcgcccttgcccagcggcacgtagaaatggacggtggtgctgtccatcgcatccatgaagaagtgcttctcgtactcgaaccggtgcgagggggtcggatcgccgacaggcagctcttcctgcttgacttcatgcgagtagagctgcggcggcgaggccgggaacaggaggcgctggccgtccaaggggccgccgatgaaatacgcccgcgcgctcatcgctcgcccccgtccccatgcagcacgccgcgctccttgcggtcggccagcttgtcgcggttgcccttcagcaacgccacgtagccgccgctgccgcagtcgaccaggggtgcggtgcgctcggcgaactcgaacgagacgttgaccatctgctgcaatgcctgccgcatttcttccagcttcgcggcggccttggcctcgtcccactgcatgccgtcgcgcatggccttcttgacgacaccctggacgatgcccgcgtgagtgcagagcgccgattgcagatcgaagccactgatccgggcttcgcggtagtgcgcgtcggcgaggcgcgtggctgcgttgcgcaccatgatggcgaacggcggcaggcccttctgctcttcgcacatgcgggcgatgtaccactgcacgtcgcccagctccttccacgccttcgcgtatcggtcggcgcggtagtcgggcttgaccgcttcttcgtcgaacagttcggccagttcgccgacctcgttgccgatgcccagggcgacgtacaggacgcccgcagtgatcgcaacggtgctgagcgtggtcggatacttcgcggtggtctcggtgaactcggcgtagcctgcggccgctgcgtgggcggcgttgacgaaggccagtcggtcttcccgcttcagagaaagagtgctcatgtgggtctctcaggtcagggtgtggggaaagtcggaggcgtactcaatctcgaacaccttcgcgtcgtcgtgcagcaccagcgtcggctcgccgtgcggcggcgggacaaccgcgaagtcgacaccgcgcgtcagctccgtacgcgagcctacgccgtcgactacctgctcgacgaagatgcgcacgtggtcggggcgctcgcgagcggccagtcgctcacgctgcaagatgcgcttggcgaccttgccgccgaacgccttgcgcagcttctcttcgacgctgcccttgtcgcgggtggcgaagatgccggtgcccggcttgcccggcactccgcgcttgtcggcgcgattgtcggtctcgttgtcgcgctgctgcaactcgaacaagcggcgctcgtctgccgcgagctgcttcttgcgccacgggctgagttccttcccctgcgcttcgagctgcttctccttgtcgtacgtgcggaacacgcgacgcaggctgcggttgatattgatgtcggctttcatgagtgtccttgctgcggatatgaaaaagcgacccggccggtattcgacagggccgctcgttgtactactcggtcaaggccgacttagcgaccggcgacgaacttggtctgcttctgcaccttgccgcgcttggtctcacggaacagcacgatggtcgtgttgtcgtcggccatgatgctcgcgtcttccagggcaccggcttcggtgatgaacggaccctgcatgccgcctgccttctgcgtgccgtcttcctgcgcggtcagcagcaggtaggcgaactgcttcgcgcccttcttgccccggcgcacgccggtcttcttcgcagccttcttgcccggcgggcggccgcgcttcggagcatcggcggcgaccttcttcggcgcagccttcttgacggccttcttggcggcgatcagcttcttggcacgcggcttggcagcggccgtgccggtggccttggtcttcttcggtgcggtcttcttggcgggggctttcttcgccgccttcttggttgcttcggtcactgcttcagcggtggcgctcatcgggtatctccattgcgttgttgtcgacaactcgcgggatgcgagcagggttcccttgcgggattcggttactcgcagcccagcgtggagccagggtgcgaggggctgtcttgcaggtattccttgaagtcgcgccagccgtctttgcaggcaaagccccagcggcggacaatcgagccggtcatgaacagcgtccagcacggctcggtgttgttgccgaacagctcgatcatgtgcatgtgcgtcggcggcagcttgcggaagtcgccagcgtggaactgctgggtgtagtcgaagcggttctcgccttcgcgcaagccgctgttcacggtcacgctgccctcgacgtatgtgcggccgtcctgcggcgagaacaggtcgctcatcgccatcacgtacgcgcccatctgcttgttatcgaacgcagggaaccactcgctcgtgtgctcgatgtagcggccttcgagaatgagcgaggcgctggcccacgggtggtcgtgcagagcgcgctcgtcgtcaccgtggacgaacttgtgcaggtacaggttgagccagcggttgcgcgggatcaggtgccagcgggtcaggtagggtcgacgctcgccgccgttgacgccatccagggtgatgacgcggctcggcttgatgaagcgcgcgtactgcttgaacgcggcgacgaacaggaaccagaggccgagcaggcgcagcgcgttgtagaagcgacgcgagactttcggtgcagtcatgggtgcgatcctcgggatgacggggtagttcattcggcgtccagatcgttttcgttggcttcggtcaggccgccggtcggagccggaaccgcacgagtgacgagctgcggcgcgggggcgaagtcgatctggtagcgctgacggaggaacttcagattttcctcgatacgcttctcgaagatttcggccagctcttcgcgggtcagctcgccctcgtggtggccgccctcgccgacgacgcgcagcttgtcttccggttcgccgtgcgtggtgaggttgcggtagttgtgctgatcgaggatcaacttgtcgagcgcgtcgcggactttcggcaggtcttgcatttcgattttcatgttgtctctcggcgtgagaattatggggtgccgtatcgtggcaccggacgccgggtttgcacttcgtcgcgagggggcgcgcttccgtgctaccgggagactggcctcggcccgtctcgttgcagctcgatcttacccggtggggagtccgaagtaaaatcgctactgcggggccactctatcgccagctccggggcttgtcaacacccctccgcgaatccggcggacggctcagccgggccatctttcgctcccctcggaacagccggtcccgcagcatcttttccgtgacgtgcgggcagttgcgttgaatctggtcgaaggtcatctcttcgccgtcgatccggtagagcctgaccgtccccacgcgcggcagttcacccattgcgtgcgccccgtccgtacgtttcgaggtacacacgatgcagctcttcgtgtgcgatggccttgcggaaccccttctggccgaccagggcgtgcgcgaagtcgtgagcactcggttccgggttgccgatgtgctccgtcatgcgcagcgtctcgttgatgtacgcctgcggctcgccttcgacgtagccctcgtccgcgagcaacccgtggatcgcctcacggtacttccggttgcgatgcttctccgcgaccagggctgcgaacagcgtgaggttcgagagaatccagagcgccgtcgccgcgtccatcactcggcctcttcgtcgtcttcgacttcgcggatcagcgacaggtcgtacatgccgtcgccccacttctcggcggccagcgggccagcctgccgcgcgtcctcggcttcgatgtcaccaacgtggcggccgtctttcacgatgcgatatttgggcattgcagttactccggtttgggtgagatgtgcagggtgtcgagaccctgtttgatgcgcttttccacgtgcttgccgaactcgctcgcatcgccgaacaggatgtcgaggtcagggtcggagcactccgctgcgatgccgcgcattacgtcgagcagcatcggcaggtggtgttgcgagctgtagttctggtggatcatcggccacgcgccttgccgcttccaccacgtcttgcgttcgccctcggtcatgccgacgtagatgtcgatcatcgcgcgggccaggaacggcgaccagaagcaggtatcgaccggcgtgatggagtcgccgaactcatcgagcgcgaagtacaccgcgaagatcggcacgccctcaacggtgtagaccggctcatcgagcatgtccttgtacgtcgcgatggtgtagccccggtaaggagccatgtgttcgtagcggcgcttctcgggcggcgggaggggcattggaaagctctcgttgaagtacgggtctgcggtggcggcggcatgcatgcacgcctgcggcgggtcacgtgcggcggcgcgcatggccgcgtagttgcggtcactcatgcgccgcctgcgtctcggatcagcacgacaggctcaccatcggcgtccccgtcaggcaggcatgcggcgagcacgtcggccgcgccctgggcgtcgccgagcacgagcaactggatggcggcgcggatcgcggtttcggtctcgactgctttgcgttcggccgccagcacgtaccccgcaccgtcgcacagctcttcgagcagatgccgcaaccactgtgccgccgtgaggtctttgcggtccaggctcacgccatacttcttcagccctgcctcggcgcgctggcggatgatcgcgatgaggtcgtccgtggtttgcatgtcgctcatggtgtttctcctagtagcggcgcgtcggcgtcttttcgacaacgcggatgtcgtgggcggggaaagaatgctcgccgtcgttctggtcggtgacgtggacccaaccctggtcgaacgtgcagctcttggcgttgcggaagatcagcggcggcgctccgttaaacgtgatgtcgactcgcatcacagaaccctcgtcgtgatgtgcttgcacgcgccttccgtcaggcggtagtcccacatgctcttgtgcttctcgcccgtggccgcgtcgacgatccacgacacgtcggaaacgccgaaacacttcacgcgtgcgatgccgatccgccagtcgtcgccctgcttggcctgataggtgcaagcctggaacagcatcgcgttgctttcgtcggcctcttccttctcctgcttttcgatttccagcatctcgggcgtgatgagcttcagaccagccgccctcacgtcgatattccgaccgtcagacatgcggatgctcacccacgtgccctccatgttgttccacacttcgttgatggtggcgcgctcgcccttcttgatgccgtcgatcttgcgtgccagtgccgtcttccagtcgccgggcgacatgtcgcggacggcttcgacggtgtagcccgaaatgacgctgataggggcacccgccacgttctcaaagctgacccgacctgcgagtccagcgtagtggtcgttcatgtcaaaactccttgtggaaatctttctcggcccggatgagagccgaaaccttggggccgaactttttcggcgtgtcgagcaggatgtcggcggcaccgattgcgacctggggcgagatgaaatagccctggatcggatgcagcacttcgccgaactcgtcgacgatgtagtaggcgacatgcacgcccactccgtcgagcacgatcagcgggccgccgtcgctgcgcacctgctcgctgtgcagctcggcaatgaacacgtcgcggtatggctggatgcgcttgtacttcatgcggccttttccttcaggtggtcgagctgccagcccgcttcgattgcagcgaagagccgcagctcgctcgcgtcctcgtggtcgagcttcagcagcgtcacgaaagcatcgatcatctgcggcgtcattgggcgcttgtcgtagaacctgcggtacgcgctgttcgggtgcatgtcccacacgtcacacaagtcgacgattcgcttgccctcttcccgcaggtgccgacgcatgatgtcgcgcgtggtcttcgggttcttctttaccgtgatcttacggccggtggatggacggaaactcacagcccgatgtcctccgcttcttccttctcgtgttgcttcagccaatgcgtctccggcaggaacgggaacgggccgagccaaccgataacgttgccgtactgcttggcgaacccgtactgatcgtgccaagcgtcgcgacgccacacacagacgcggaactgcttgtagtgcggcgactggcccggccacggttgcaacagcaccgcgtagtagcccatctcgctcgggtcgtcgagcacttccatgtcgttcagcgagagcggcccgtaccacccgtaaatctgagtgtaggtgcgcgacttgtgcagcgtctcgaaccacccgaagcggtcgttgaactcgaagacgtggtacgcgcgtcgcttgctgttgatcgtcgggtagtcgcaaacctgcacgatgtagaaaccggcttcggtcacgtcttccaaggcttcgagttcgagcattacggcagctccacgtttgtgcgcagcgggcggatgcggggcagcgggccgacccaaccgtggacttcaccgcgatgctgctggtcgcttcccaggtagtaccaatggccctcgtaccacacgaggaacgcgtcgacgacgaggttcacgaccttggggtgatctacgcggactgcgtagacccccgtttcagtcggatcgccgatttcttcgtattgcaccttcacgggatgcccgcctttgccgtgtactcgctcaacttgcgcacccagctcacgcgatcctcgatagggatcgacagcagcgaagcatggccgaactccttcagcatctccttcatcacttcgaggcccttatcccggccgaacgtgttcctgaatgcacgcgaggcgtcacgggacatctcaccgatccaaccttccatctgccggatgcgctggtcccgcttctcgacgttggcgaggcgctgctccgcgagggcttcgacttccttcagcgaatccttgaaggcaatcagctcggattcgacctgcacgccgccacggaacagcgtgcggatggcacggatgatgagcgcgcagtcgtcgtacagcacgcccggcggatcgtagtcgcgccaacccggcacacgacggtccagctcgcggccgatgacgcgaatccaacgcaccgcgttctcgccctcattgtgcgtcagcatgtcttcgcggacttcctgcatcaccgcgccgttgtcgttctcgatgtcgatgtagacaaccggcttgacgttgccctcactatcgagcggacgccatttcgcgagccactgtgcatgatcgcggaaagtgtgcttgttgcgaccgtagtggacgccgcccttatgcgtgtccagcgtcaccgtgtgcgtgttgaagtccccctgctgcacgtcgaccaccgtgtagatgtgctcgctgccgacgcgctggtactgctcgccgaccttcggcggcagctcattgccgtggaagggcacgccgtcaagcacctgctgcgtggcgtcgacaacgttcctcggcgcttcggcttcagcgacaaactcagcctcgacaccgctcgcgcgctccgaccgcaggaacgcctgggcgtcgagctggtacgcgtacgggccgacgctgctctgcggcgacagcggagccagggcggtctcgcggtcgacaggggtgaagaggtcagcccacgagcgcgtgctttcccacacacgatcttccggctcgccgtcctgcaagcagtgcatctcgacatgccagtggcgcacgcactgctgcaagccggtcacgcggtagaacttcgtcggctcagtgcggctctgccagtaggagttgatcgagaacgccgggccttcgttgtagttcttcgagtagacacgttggtcgaagctctccatgccgaccttcttggcccacttttcgaggtcgccgatcacgtcgccagtgtcgacgcgcagctcgatgttgacttccttcttgcctgtgcgcgcttcgatgtccagcaggtcgacgcgcagcaggtcgagaatgcccggcgagagcagcatggcttcagcgatggcgtgcgggtcgatgtcgtcgagcacgatatagcgacggtcattgtccttcaggaagtctatgctgccggaaagcatgtggagctgagtgcccgggaacaggtcgcgccccgacgtggctcggaacgccgcttcgctcttgccctgaccgaagctagaagtaaagccgccggagtggaagcccggctgcggcgacggcacgacgccgttgtgcgattggaacatcacgatgtcctggccggtgaacgtgactttggcccactggaacatgcgctcagcctcggccatttgaccgtcatccaggccgatgtggtagccgcgtcggcggtggatagagaagacaatgccctcgtcgttgcaggtagcgatgaggggcagaagcaccggcttcggtgcgttgttggtgaactgcttatcgtacatatcggcggtccttggttgggttaggtggtgcttacgtggcctgcggcttcgcggtcgagttgcaggtcggccatgcccagcaactcttcgtcccaatcgtcaagcgacatccagccgttgacgtgccagtggaggtcgttgagcgtcagcctgggccagaagtagctgtgatccagtttgttctgctcgatgtagcggttgagtgctgcgccccacttctgcgcctcgacctcgcgccacgtcacttcaccctgaccgtggcacagcatgcagatgcggatgtagttgtcgcggagctgcgtggctccctcgcacgccgggcacacctgcttgtcgcggagccagcgggagagcaggcgcatgcgttgccatgcggccagacggattgcagcgagcagtagggtggtggcagcacgcgcgcgagacaaagggggtactcgggcattctgaaaaaccgaaaccctttgggccaacattttgcccttctccaattccatcacggtgtacttgcgcatggccgttactcggtgcgagtgatggtcaggaacgcgaacatggcgtcgttgctggccgtcatgtacgagccgcgttccatcgtgaagcgcttgcttgcgtgctcgggtgcgctgcgcaccttggcgatgccgccggacagcaccgagttcttcgccttgaagaacgattgcgcctgggacgacagcgtggggccgttctctactacgaatcgacgcacgtggcccagcgactcgccgactttgagcttgctgatctggtcgttgagcgagccgggcaggaacaggacgcgcggcttggcgaccttcggcttggcggcggtgctcttccgcttggccgcaagttccttcttgacggtggtcggcatcttgcgcggcttcttgggggcggtcgtgctggtggtgctggcggatgccatcgggcgaatctcctgtgccgtggttggagtaaagggacaggacaaatactactgcgcggccgggggcagttgtcaagcgcccggttctcggtcgtgaccggccgggagctggccgccctgctgcacaaaggtccggctgggtttccgaagcgggagaaaaattgggtccggctgggtctccgaagcgagagcgcgctggctttcgagttcggtttcggcctgccgtggatttttggaacgggctgactttccgaagcgggggctttttctgtaccggaggcatacgtgtacgcggacgcgcgcacgcacctgcacgcacacccgcccgcgctcctgcacaggtcacgcgcctcacctgcgggcgcgtgtcaatgaacgcgcgccgcgcgcggttcgttctcctggccgcgtcgctcatcctgggaagcgctgaacgccgttcagaaaaataattgaaaaaagtatttgcactactgcgcgaggggtgctgtaattcttccaccggcaggcaacaccgccccggcaactaacaaagggaaagcaaccatgaacgcaacgaaccgcaccgccgccattcgcgaagccgccgccctggctgattcgatcatcgaacagcgcacccgccttgccgctggctgggatcagggtatgaagcgcgacgacgaaccgcgctttaccggcgtcaccccgcgcatgcggatggaacgcgacagcgccgccgctttcgcactgtccgcgcagttcgccaccgacgacgtgcgcgaaggcggcgcggttcgcaacgtggttgccaagctggcccacgacatcgctacccctgtcaccgatacggagattcgcgcagccgccgaccgtgctatggcgctggcccgtgacaccctggcgcagcgtcgcccgttcctgggcgtgttcggtgccgccgatgaatccggcatcgccgacgctgcaatggcgaaggtgtgcggttatgcctatctggcgatcatccagaacaacaccgtgagcatcacgacggacgccgacggcatgctcacgaaagcgtgcctcaatcgtgctggcgtgatcctggccgctggcgacgccgttaacgccctggtgcaggcatgagccgccgcagtcgctccgactatgacgcgcacgcgggcctgtccgctgcgcgcagcaccgcaccgcgtccggtgcgcaagcctcgcgcctcgctccccgtgtcgcgcgtcctgggctggctggcgtgggttgtcgtcgccgcagccgcctatcactacgcgccgcgcgtcgcggcccttgtccgggagttcatctaatgcgcgctttccttatctcgctccctggcgtgccggtgttcaccgtccacgccgatgaccgccgcaccgctcgcaattacgccctgggcttgcacggctacaccgtgcgcccgccccgctttatcaccgtcacccccgtctaaggaatcgcacacatgaccatttccctttcccaagcgttcgcacagtggcaggagttagccgccgacattccgaaggatgacggcccggccctggccgaatcgtggaacgactacaccgattcgctttgcaaagacggcgagttgtgcgcgcttcagtatcactacgcgcccgcctatgacgacgacatgcccggcgaaggctcgcgttacgatgaactaagcgatgatcgcgctttcatcctggaacagatgggcgtgaccatgagcgccgagtttgtgccgtttcacgcgtcgcgcaacaaagatgaaaaatcgccgtcgcttaactggcgcgtgacgctgaagaagggcgaccgcgaagtgttgacgacggattacatgcaaggttgcgggcactgcccggcggaacagcgcaacaatttcaacacgccgaccgtcaacccgaaaaccgaaaagcgcgccgccattgcgcaggaatgcgatacggggttcgaggcgaagggcggaatgatgggcggccagttcaagcgcggccgcaagctagagccggaattggtggacgtgttttatagcctcctgtccgactcgcgcgtgttggattgccgcgacttcgccgattgggcgagtgattacggatttgattccgacagcatcaaggcgcgcgctatctatgacgcgtgcatggccgatgcgctgaagatgcgcgccgcgttcggcgataaggcgatgggcgagcttcacgaactgttcgagggcatgtaatcatgagcgacgttatccactcctataccctggaacgcgacggccttacgttccgcgtcgatcactgcgccgacaccgacaacggcgcaccctgggaaaacgaagatggtcacggcaccgtgtccgactggactacgcgcgacaagtcgccgggcgaattggtgttgaacaccgatcacggtagcaaacgcttttatgacttcgccgacgcgtgccgcatcgcgctgcgcgacggctggggcgcgcgtggcgctgaagagggcatgagtaagcgccagattgccgcgctcgccgctcgcgaggattacgaacaccttcgcgcatggtgcaatgacgaatggagctatatcggcgtcgtggtgacgttgctggacatcgaaggcaacgaaacggacgcgacggattcgctgtggggtgtggacgataatggcgactacgcggccaccgttgcgagcgattgcgtggacaacgtgatgcacggcatttcggccatgctgtatggcggcgacggcgcggtgtacatgagcggttcgcgttcgtggagggtgaaggaatgaatatcgacaaccccgcccacggttacctgcgcgacgcgttgcaggccgcttacctggaatacctcaatgcgtttttgacggttgcacgtttcgccgcgcatcacgacattgacgaaaaaaccgcatgggcgattatcgacatgggccgccgtatccacgaggagcgcaccgcatgaacgtcctgtcgcatggcgaacacgtcgcctcaatcaaccgcatgcataaggccgcagacggctacacgccggaaacgccgtggttgctgctgcacaacactggccgcgtcgaccgcttcgcaacgcaacgcgaggcaaaggaagaagcgcgcaagagctacccccgcgttacgttcgaggtgcgctaatgatgactttctcccttgtgttggtgttgatcctgggcggcgagcggcacacgttcgtcatggatagcggcctgaccgcaggcgattgcgtgcaagccctggtagacaaccccggcgcgcctttgcgctgcgaaaaggagtgaccgacatggccgattccctggaacgtctcgccctcgccatgcgtgcgcaggccctcatccaccgcgagcgcggcaggcacaaccgcgcaaaggaattggaggggttcgccttcgccgtggaaacgtgcgccgccctggatagcgccacgttcgcgccaatgccgtttgccgtcatgtgtcacaccctggccgaccgctgcgccgacatcctgcgcaacgatgatgcgcaagtgcgggcgggtcagttcgagcgactgcgcgacgccgaccgcgtggccgtgtctcgcctgcgcgcttatgcgcatggcgtgggcgatgaggcagacgccgcgcccgaactgtttaaggagacgcgcccgtgagcgttcgcattgtcaaaagcccgggccgcgctaacttcccctgggcggtgcagttcaagccgactgaaaattggtcgactgctgcggcctacgccgacaaggggccagcggtggagcacgccgaacggttgcaggcggaatatccgcatctgccggtgcgtgtgcagcactacacgggagggccgcaggcgtgacgccctacacgtattggctgcgcagcactgaccccaaggcgcgcgtattcgtggctgaagggccgcacgaacgcgacacgtcgctagcgctcaccgcgcgccgcctgggcgtcaaggtgtcgacctcgcgcggcgtggccgtgtatggcctggacacgacgccggttgtgcgcgtggtgaaggaggattgacgcatgaccctggaaccactgaccgaaaccgaaaagcgcaaaatcatccgcgcaaacattctggccgatagtctgctgcgccttgtgcagtgggttgcgttcctggcgatcctgggcgcgcttgtcctgccgctggcagtgcaggcgtggcacaaggccggtgcgatcaccgccgccgtggtgcttgccctgggcgtggcctgcgcgtggcacgtcaagccacacggccgcagctacgcggcgcaggtgcgggacatcgaagcccggcacaagccacacgaataaaaccccgcacccccacacccccacgtctgccactgtctagccctcgctcacgcgggggctttttattgcgcgttcgtctgtccctgggcgctcgccctggccgcctacccttgggcgcgcctttccctggtaacgctatggcctgcgcagtgagcacacctgcgcgcccgcatttgcgcatttccgcattgcgcacgtcctgctgactcgctaacggcctgcacctgggcgcacgtcctgctgatttgtggtcgacctgcggcacacccgatagccctgcacctgggcatttcccgcattgcacgcatttaatttattgcatgggcctagaggcgcgtgtgcgcgtgcgtgtgcgcattgcatttatttcccttttattcgcatcaccgcatggccgcgcggcccgcacgcacgcattgcggcggcgcaggagggtaaaagggatagcggcgatgcgagtaaaaaggtacttccggccctggcgcgggcgtcgcggggggcgctgaccccggtgctcgcgcatttttcaattttttcgcatttccgtctcctataaggggccgaaccgcgcgctgcaccgcatttccgggctaggaattaatttattcgcttgtgacagtagtgacactgacgatttgcggtactgtcacaactcggccccccgcgcaaacggttgatttggaagggttttgaggtcgatttgctactgcgagttgggcctttgtgacactgtgacactgaaaccttctcccttaccgggaaagaaaacacgaaaaacggccacaaattagtaccattgctaatatttgagggacaattcgtattcctgcgtgtagcagaaggtactgtcactactgtcactactgtcacaaaataagaggaaaagtaggcaggacaagggtttcggcttgtgacagtaccttgtgacagtgacgcttttttcgccacatcggcccaaattaattcgtcagtgtcacaaggagttaattcccgggcttgtgacagtaccttgcgcgattggaaagaattgccgataattaattcgccggaaattcgtccggcacaccgagaaatgccgatgatcgctgaaaccgacgaaattgagagcacgcgcgctgacttcgaggaagccgtctacaagaaatatttcgtgtcgcagatcagccgcaccctgctgctgaaaaaaggagtggccgacaaggcgaccctgctggaacggaaaaagaaaggcgcgtaccggcggccggaaattgccgcgatgtggttcgggtggaaattgcgcattgaggccaagccggacccggcatggcaggatcgagtcggctaattcggcgcaacgaaaaacccccggggcgacccgggggtttctttttgcctcgctgccggtgtgcgtttattcgacgcgggtgtccggcacgttcgagccgggttcgccagcgcccggcggcagatcgcggcggccttcgtacgcagcggcgtcggtcgtggcttcgtctacggtggcctggggctgctgcacttccgacttggtgctgccgaagaactctccggtctcgtcgatggtgagctgctggcccgagtgcaggctcacttcgatgctgcggcccgggccgagttcgccgacgctgttgccttcgagcttgacggcgagcgccttgttaccgtggacgtacgagagtttgacggtggtggtcattgcgtttctcctgtgccctggattgggcggttgtaggttacatcttgatgcgtgcgagttcgatgaagtcggtgatccaggcttgcaggttcggcttcatcaccagctcgggatgcttcgaccaatagcgcgccagcttgccgctcgcaccgcgcgcccggccaacgtagacgaagcccttggcggtcaggaagttcgacagcttcggcccgaacggaactccgcacgacgcatccagcgccgcgtcgcgcagcctgccgacgttgagcagcatgttgttgacttccgggtcggtgctctcgttgatgatttccagcagctcgtcttcgtcgtcgccgcgagccaggtcgatcatgcgttccttggcgtccgtcatcggcgcgtggccgtccgggtcgaactcgggatgcagcgggtagtcttccagccactcgcgcagcgcgcccgcgtgataggcgatggcgttgaagatgtcgtcgtagtggtcggggtgctgcgcgcggaacttctcgatcatctgcttcgtctggaagtgagtcgagaccacgaagtaccggcggtcggcgtcgtacaccggcagcgcgtcgctgtgattggtcaggatgatcgtggagctgacgttcggcacgttgaagccgccgctgtgcatcttgcggatgtccaccacgtcgttcgtgatgtagggcttcagcttgtccatcacggcgtagcgcgacgtaccggcgatgcgggcttcctcgaacacgacgaccttgttgcgctcgtagaactcggtgtacttctcttccaggcgttgcgcgttgacggtgatgacgttgttcttcgacaggatcgccatgagcatttcgccgacgaaacccttaccggcaccgtcgataccctgcatcaccacggcccagcgaatcttcttgtccatgcgcttgatagtgaacgccagccaggacagcagcagctcgcgctcgcgctggatcgggtaggaaatctcgaagtgacgcttcaccgcctcgaccgcacgccgcgccttgccgcccatcttctcggggatcggcacgatgtcttccgggttgaacaggttgacgtgcttctggtcattccattcaacgattcgctcggcaccgggcaggtacacgtagccgctcacgaccggaacctgatacacgttgagcgccagggccgatgcctgctgctccggcaccgcgtccatgttcgagcgatccttcttcgacagcaggtggcggttgttgcgcgcgttgaacgcacgctcgctcagcgcgacgcggttctccatcaagaagaactcttcctcggtgtcgacgtacaccacgtcgttgcaccagaacggcagctccttgtagttgaagtcggaattgcggtagccctcgttcaccgccttgcgtacggtcgcgatgctcggcgacttgccggtcagctccttgacgcgcttctggatttcgcccaccagcagctcggcctgatagtcgtgctccatcaaccggccccacttcttcgccagcgggccaagaagttccatcgcgctttcggtctcatgtaccttgcgcttgatcttctcgaactgttcctcggcgacctcctgccggtgctccttcgcgatcttgatgagcgatgcggccgtggtgatgttccggcccatctcatcgtggaacgtgttccacttttcttccagcgagtcggcgtcgtattcgctcgacgtttcggaccactcgtgccagagcgacaggccctcttcctcgccgtcgaattgatggtgcagcgccatgccgaccttcaaccactgctcgtagtcgtcagcacccggcacccattgcagcacctcgcggagctgatcggcggtcaggttttcgagcggctgcttgtgcgccagcagtgcgcggtcgttctcgtcgtcgatgtcgtcgcgactcgcatcgcgcggtgcgttgtgcttcttcaacgtccagccgcgacgctgcgcttcgagcttgaagaccgagaacaactcgtcgatggcgtcggtcgtgatttccggcagcatgtcgtgcggcacgctcaccgggttcatgcccttgccggaagtccagcggtacggcttcttcgtctccgggtgcaggccgatgccaacaaactgctggccgtcgcccaggacttcgattgcgtgctcggtaccttcttcgtcgacgaaggtgatcttgcgcttctggaacgggatgtcggtgcggtacacgagcatggtcttcggggccatgccgacacgcgtcatcgtcttgccgcagatttcaagcgcgtgctcggccatcaactcggccatctcggcgtcgtagatgtcgatgtccacggcaggcgtgtgcttcgtcaagaagccgatgttgccctgcgtgtagtcgccgctcgcccacttctttaccagcttcggcgttgcttcaatatgctgccacttcggctcgattgggcctttccgtcccttcggaatcgggatgatggagtagccgttttcgagcaactgcgcgccgtatttgcgaagcacgctggtgatcggtcgtccagccatgtgcgtcactccgcgatgtcgtcgccaacgaggtcttcgagattgaatccaatctcacggttgaagtctttgtgcaagatcgaagccttgtcgcgcggcacgcatccgagacgttgccaacgcgacacggtggtctcgtgccagttgtacttctcgcagattgcgttgagccgaccgtacggcgggtcgagcattagggcgatgcgccggagtagatagcggacgcgcgcgtcggcgctgtccagtgaatcaagggttaggtctcggcgcatggaatcctcgcggcgtgtgggtttcaaggggtctgctaagccgctttgcgtgcctattgacttagcgttgggacgggcgcatagtgcgctcgccgggcaggaattgcaatccgcccgtcactcccaaaaccaacctagctaggagcaacaaaccgatgtccaccatcaacgcgaagaagctcgccgccgccatcgttctcatcatcgaagccgtgggcgggaccagcagcaacagctccgtcaacgaatccgaagacggtggtgacgaagaagaagcgccgaagcgcggtcgcggccgcccggcgggcagcaccaagaaggcaccggccgagaaggccgctccgaagggcaagggcaagtcgaagcccgacccgctggacgacgaagacgaagaagaaggtgacggcgacgaggacgaaggcgacgacgacctcggcctggaagacgacgaagaagaagtgacccaggaagagctggtcgcctccttcaaggcgctgaagtccagccacggcgtcgacgcctgcaagaaggtgctggccctgctcgacgagagcaacgtcctgaacattccggccaagaagtacccggaagcgatgaaggaaatcaagcgcgcggccagccgcaagaagtaattcggcctgcacgtaacacggacgcccggcgatgccgggcgttctttcgagaggacacgatgaagccacgtcgcaacaaactcgcaaaggccgtcaaggaagcagtgcgtgcgcatgcgcgctttgcgccgtcgtctgcacagcgcatcttcgactgcccggccagcttggtgctcaacgagcaggagccggacagcgagaactacgaggcggccgaaggcaccgttgcgcatcacatcggcgagacctgcctgttgaccggcaaagacccggaagagtttctaggaatggtgttcgatagcggcaaccttgatgccgactacgacgaagagcttcattcctcgaaaggcttcgctatcactgttgacgacgagatggttgctggcgtcggtcagtatctcgattacgtgatgcgtctgccggggtgccacttcgttgagcagcgagtgaacatctcgcggtggtgcccgatccccgatcagttcggcacgtgcgaccacgcagcggccatgtacaagaagctggtcgtcaccgacttcaagtacggccgtatcttcgtcgagccggagaacaacttccagctcatcatgtacgcgctcggcttcatcaacgagtgggactggctgtacgacttcgacgaagtggtcatccgcattgcgcagcc

SEQ ID NO: 13 - DNA, 56164 bp, Unknown
  Bacteriophage Xfas103
atactaggtgtggtcgggtcagcgccccccgcgacgcccgcgccagggccggaagtacctttttactcgcatcgccgctatcccttttaccctcctgcgccgccgcaatgcgtgcgtgcgggccgcgcggccatgcggtgatgcgaataaaagggaaataaatgcaatgcgcacacgcacgcgcacacgcgcctctaggcccatgcaataaattaaatgcgtgcaatgcgggaaatgcccaggtgcagggctatcgggtgtgccgcaggtcgaccacaaatcagcaggacgtgcgcccaggtgcaggccgttagcgagtcagcaggacgtgcgcaatgcggaaatgcgcaaatgcgggcgcgcaggtgtgctcactgcgcaggccatagcgttaccagggaaaggcgcgcccaagggtaggcggccagggcgagcgcccagggacagacgaacgcgcaataaaaagcccccgcgtgagcgagggctagacagtggcagacgtgggggtgtgggggtgcggggttttattcgtgtggcttgtgccgggcttcgatgtcccgcacctgcgccgcgtagctgcggccgtgtggcttgacgtgccacgcgcaggccacgcccagggcaagcaccacggcggcggtgatcgcaccggccttgtgccacgcctgcactgccagcggcaggacaagcgcgcccaggatcgccaggaacgcaacccactgcacaaggcgcagcagactatcggccagaatgtttgcgcggatgattttgcgcttttcggtttcggtcagtggttccagggtcatgcgtcaatcctccttcaccacgcgcacaaccggcgtcgtgtccaggccatacacggccacgccgcgcgaggtcgacaccttgacgcccaggcggcgcgcggtgagcgctagcgacgtgtcgcgttcgtgcggcccttcagccacgaatacgcgcgccttggggtcagtgctgcgcagccaatacgtgtagggcgtcacgcctgcggccctcccgtgtagtgctgcacacgcaccggcagatgcggatattccgcctgcaaccgttcggcgtgctccaccgctggccccttgtcggcgtaggccgcagcagtcgaccaattttcagtcggcttgaactgcaccgcccaggggaagttagcgcggcccgggcttttgacaatgcgaacgctcacgggcgcgtctccttaaacagttcgggcgcggcgtctgcctcatcgcccacgccatgcgcataagcgcgcaggcgagacacggccacgcggtcggcgtcgcgcagtcgctcgaactgacccgcccgcacttgcgcatcatcgttgcgcaggatgtcggcgcagcggtcggccagggtgtgacacatgacggcaaacggcattggcgcgaacgtggcgctatccagggcggcgcacgtttccacggcgaaggcgaacccctccaattcctttgcgcggttgtgcctgccgcgctcgcggtggatgagggcctgcgcacgcatggcgagggcgagacgttccagggaatcggccatgtcggtcactccttttcgcagcgcaaaggcgcgccggggttgtctaccagggcttgcacgcaatcgcctgcggtcaggccgctatccatgacgaacgtgtgccgctcgccgcccaggatcaacaccaacacaagggagaaagtcatcattagcgcacctcgaacgtaacgcgggggtagctcttgcgcgcttcttcctttgcctcgcgttgcgttgcgaagcggtcgacgcggccagtgttgtgcagcagcaaccacggcgtttccggcgtgtagccgtctgcggccttatgcatgcggttgattgaggcgacgtgttcgccatgcgacaggacgttcatgcggtgcgctcctcgtggatacggcggcccatgtcgataatcgcccatgcggttttttcgtcaatgtcgtgatgcgcggcgaaacgtgcaaccgtcaaaaacgcattgaggtattccaggtaagcggcctgcaacgcgtcgcgcaggtaaccgtgggcggggttgtcgatattcattccttcaccctccacgaacgcgaaccgctcatgtacaccgcgccgtcgccgccatacagcatggccgaaatgccgtgcatcacgttgtccacgcaatcgctcgcaacggtggccgcgtagtcgccattatcgtccacaccccacagcgaatccgtcgcgtccgtttcgttgccttcgatgtccagcaacgtcaccacgacgccgatatagctccattcgtcattgcaccatgcgcgaaggtgttcgtaatcctcgcgagcggcgagcgcggcaatctggcgcttactcatgccctcttcagcgccacgcgcgccccagccgtcgcgcagcgcgatgcggcacgcgtcggcgaagtcataaaagcgtttgctaccgtgatcggtgttcaacaccaattcgcccggcgacttgtcgcgcgtagtccagtcggacacggtgccgtgaccatcttcgttttcccagggtgcgccgttgtcggtgtcggcgcagtgatcgacgcggaacgtaaggccgtcgcgttccagggtataggagtggataacgtcgctcatgattacatgccctcgaacagttcgtgaagctcgcccatcgccttatcgccgaacgcggcgcgcatcttcagcgcatcggccatgcacgcgtcatagatagcgcgcgccttgatgctgtcggaatcaaatccgtaatcactcgcccaatcggcgaagtcgcggcaatccaacacgcgcgagtcggacaggaggctataaaacacgtccaccaattccggctctagcttgcggccgcgcttgaactggccgcccatcattccgcccttcgcctcgaaccccgtatcgcattcctgcgcaatggcggcgcgcttttcggttttcgggttgacggtcggcgtgttgaaattgttgcgctgttccgccgggcagtgcccgcaaccttgcatgtaatccgtcgtcaacacttcgcggtcgcccttcttcagcgtcacgcgccagttaagcgacggcgatttttcatctttgttgcgcgacgcgtgaaacggcacaaactcggcgctcatggtcacgcccatctgttccaggatgaaagcgcgatcatcgcttagttcatcgtaacgcgagccttcgccgggcatgtcgtcgtcataggcgggcgcgtagtgatactgaagcgcgcacaactcgccgtctttgcaaagcgaatcggtgtagtcgttccacgattcggccagggccgggccgtcatccttcggaatgtcggcggctaactcctgccactgtgcgaacgcttgggaaagggaaatggtcatgtgtgcgattccttagacgggggtgacggtgataaagcggggcgggcgcacggtgtagccgtgcaagcccagggcgtaattgcgagcggtgcggcggtcatcggcgtggacggtgaacaccggcacgccagggagcgagataaggaaagcgcgcattagatgaactcccggacaagggccgcgacgcgcggcgcgtagtgataggcggctgcggcgacgacaacccacgccagccagcccaggacgcgcgacacggggagcgaggcgcgaggcttgcgcaccggacgcggtgcggtgctgcgcgcagcggacaggcccgcgtgcgcgtcatagtcggagcgactgcggcggctcatgcctgcaccagggcgttaacggcgtcgccagcggccaggatcacgccagcacgattgaggcacgctttcgtgagcatgccgtcggcgtccgtcgtgatgctcacggtgttgttctggatgatcgccagataggcataaccgcacaccttcgccattgcagcgtcggcgatgccggattcatcggcggcaccgaacacgcccaggaacgggcgacgctgcgccagggtgtcacgggccagcgccatagcacggtcggcggctgcgcgaatctccgtatcggtgacaggggtagcgatgtcgtgggccagcttggcaaccacgttgcgaaccgcgccgccttcgcgcacgtcgtcggtggcgaactgcgcggacagtgcgaaagcggcggcgctgtcgcgttccatccgcatgcgcggggtgacgccggtaaagcgcggttcgtcgtcgcgcttcataccctgatcccagccagcggcaaggcgggtgcgctgttcgatgatcgaatcagccagggcggcggcttcgcgaatggcggcggtgcggttcgttgcgttcatggttgctttccctttgttagttgccggggcggtgttgcctgccggtggaagaattacagcacccctcgcgcagtagtgcaaatacttttttcaattatttttctgaacggcgttcagcgcttcccaggatgagcgacgcggccaggagaacgaaccgcgcgcggcgcgcgttcattgacacgcgcccgcaggtgaggcgcgtgacctgtgcaggagcgcgggcgggtgtgcgtgcaggtgcgtgcgcgcgtccgcgtacacgtatgcctccggtacagaaaaagcccccgcttcggaaagtcagcccgttccaaaaatccacggcaggccgaaaccgaactcgaaagccagcgcgctctcgcttcggagacccagccggacccaatttttctcccgcttcggaaacccagccggacctttgtgcagcagggcggccagctcccggccggtcacgaccgagaaccgggcgcttgacaactgcccccggccgcgcagtagtatttgtcctgtccctttactccaaccacggcacaggagattcgcccgatggcatccgccagcaccaccagcacgaccgcccccaagaagccgcgcaagatgccgaccaccgtcaagaaggaacttgcggccaagcggaagagcaccgccgccaagccgaaggtcgccaagccgcgcgtcctgttcctgcccggctcgctcaacgaccagatcagcaagctcaaagtcggcgagtcgctgggccacgtgcgtcgattcgtagtagagaacggccccacgctgtcgtcccaggcgcaatcgttcttcaaggcgaagaactcggtgctgtccggcggcatcgccaaggtgcgcagcgcacccgagcacgcaagcaagcgcttcacgatggaacgcggctcgtacatgacggccagcaacgacgccatgttcgcgttcctgaccatcactcgcaccgagtaacggccatgcgcaagtacaccgtgatggaattggagaagggcaaaatgttggcccaaagggtttcggtttttcagaatgcccgagtaccccctttgtctcgcgcgcgtgctgccaccaccctactgctcgctgcaatccgtctggccgcatggcaacgcatgcgcctgctctcccgctggctccgcgacaagcaggtgtgcccggcgtgcgagggagccacgcagctccgcgacaactacatccgcatctgcatgctgtgccacggtcagggtgaagtgacgtggcgcgaggtcgaggcgcagaagtggggcgcagcactcaaccgctacatcgagcagaacaaactggatcacagctacttctggcccaggctgacgctcaacgacctccactggcacgtcaacggctggatgtcgcttgacgattgggacgaagagttgctgggcatggccgacctgcaactcgaccgcgaagccgcaggccacgtaagcaccacctaacccaaccaaggaccgccgatatgtacgataagcagttcaccaacaacgcaccgaagccggtgcttctgcccctcatcgctacctgcaacgacgagggcattgtcttctctatccaccgccgacgcggctaccacatcggcctggatgacggtcaaatggccgaggctgagcgcatgttccagtgggccaaagtcacgttcaccggccaggacatcgtgatgttccaatcgcacaacggcgtcgtgccgtcgccgcagccgggcttccactccggcggctttacttctagcttcggtcagggcaagagcgaagcggcgttccgagccacgtcggggcgcgacctgttcccgggcactcagctccacatgctttccggcagcatagacttcctgaaggacaatgaccgtcgctatatcgtgctcgacgacatcgacccgcacgccatcgctgaagccatgctgctctcgccgggcattctcgacctgctgcgcgtcgacctgctggacatcgaagcgcgcacaggcaagaaggaagtcaacatcgagctgcgcgtcgacactggcgacgtgatcggcgacctcgaaaagtgggccaagaaggtcggcatggagagcttcgaccaacgtgtctactcgaagaactacaacgaaggcccggcgttctcgatcaactcctactggcagagccgcactgagccgacgaagttctaccgcgtgaccggcttgcagcagtgcgtgcgccactggcatgtcgagatgcactgcttgcaggacggcgagccggaagatcgtgtgtgggaaagcacgcgctcgtgggctgacctcttcacccctgtcgaccgcgagaccgccctggctccgctgtcgccgcagagcagcgtcggcccgtacgcgtaccagctcgacgcccaggcgttcctgcggtcggagcgcgcgagcggtgtcgaggctgagtttgtcgctgaagccgaagcgccgaggaacgttgtcgacgccacgcagcaggtgcttgacggcgtgcccttccacggcaatgagctgccgccgaaggtcggcgagcagtaccagcgcgtcggcagcgagcacatctacacggtggtcgacgtgcagcagggggacttcaacacgcacacggtgacgctggacacgcataagggcggcgtccactacggtcgcaacaagcacactttccgcgatcatgcacagtggctcgcgaaatggcgtccgctcgatagtgagggcaacgtcaagccggttgtctacatcgacatcgagaacgacaacggcgcggtgatgcaggaagtccgcgaagacatgctgacgcacaatgagggcgagaacgcggtgcgttggattcgcgtcatcggccgcgagctggaccgtcgtgtgccgggttggcgcgactacgatccgccgggcgtgctgtacgacgactgcgcgctcatcatccgtgccatccgcacgctgttccgtggcggcgtgcaggtcgaatccgagctgattgccttcaaggattcgctgaaggaagtcgaagccctcgcggagcagcgcctcgccaacgtcgagaagcgggaccagcgcatccggcagatggaaggttggatcggtgagatgtcccgtgacgcctcgcgtgcattcaggaacacgttcggccgggataagggcctcgaagtgatgaaggagatgctgaaggagttcggccatgcttcgctgctgtcgatccctatcgaggatcgcgtgagctgggtgcgcaagttgagcgagtacacggcaaaggcgggcatcccgtgaaggtgcaatacgaagaaatcggcgatccgactgaaacgggggtctacgcagtccgcgtagatcaccccaaggtcgtgaacctcgtcgtcgacgcgttcctcgtgtggtacgagggccattggtactacctgggaagcgaccagcagcatcgcggtgaagtccacggttgggtcggcccgctgccccgcatccgcccgctgcgcacaaacgtggagctgccgtaatgctcgaactcgaagccttggaagacgtgaccgaagccggtttctacatcgtgcaggtttgcgactacccgacgatcaacagcaagcgacgcgcgtaccacgtcttcgagttcaacgaccgcttcgggtggttcgagacgctgcacaagtcgcgcacctacactcagatttacgggtggtacgggccgctctcgctgaacgacatggaagtgctcgacgacccgagcgagatgggctactacgcggtgctgttgcaaccgtggccgggccagtcgccgcactacaagcagttccgcgtctgtgtgtggcgtcgcgacgcttggcacgatcagtacgggttcgccaagcagtacggcaacgttatcggttggctcggcccgttcccgttcctgccggagacgcattggctgaagcaacacgagaaggaagaagcggaggacatcgggctgtgagtttccgtccatccaccggccgtaagatcacggtaaagaagaacccgaagaccacgcgcgacatcatgcgtcggcacctgcgggaagagggcaagcgaatcgtcgacttgtgtgacgtgtgggacatgcacccgaacagcgcgtaccgcaggttctacgacaagcgcccaatgacgccgcagatgatcgatgctttcgtgacgctgctgaagctcgaccacgaggacgcgagcgagctgcggctcttcgctgcaatcgaagcgggctggcagctcgaccacctgaaggaaaaggccgcatgaagtacaagcgcatccagccataccgcgacgtgttcattgccgagctgcacagcgagcaggtgcgcagcgacggcggcccgctgatcgtgctcgacggagtgggcgtgcatgtcgcctactacatcgtcgacgagttcggcgaagtgctgcatccgatccagggctatttcatctcgccccaggtcgcaatcggtgccgccgacatcctgctcgacacgccgaaaaagttcggccccaaggtttcggctctcatccgggccgagaaagatttccacaaggagttttgacatgaacgaccactacgctggactcgcaggtcgggtcagctttgagaacgtggcgggtgcccctatcagcgtcatttcgggctacaccgtcgaagccgtccgcgacatgtcgcccggcgactggaagacggcactggcacgcaagatcgacggcatcaagaagggcgagcgcgccaccatcaacgaagtgtggaacaacatggagggcacgtgggtgagcatccgcatgtctgacggtcggaatatcgacgtgagggcggctggtctgaagctcatcacgcccgagatgctggaaatcgaaaagcaggagaaggaagaggccgacgaaagcaacgcgatgctgttccaggcttgcacctatcaggccaagcagggcgacgactggcggatcggcatcgcacgcgtgaagtgtttcggcgtttccgacgtgtcgtggatcgtcgacgcggccacgggcgagaagcacaagagcatgtgggactaccgcctgacggaaggcgcgtgcaagcacatcacgacgagggttctgtgatgcgagtcgacatcacgtttaacggagcgccgccgctgatcttccgcaacgccaagagctgcacgttcgaccagggttgggtccacgtcaccgaccagaacgacggcgagcattctttccccgcccacgacatccgcgttgtcgaaaagacgccgacgcgccgctactaggagaaacaccatgagcgacatgcaaaccacggacgacctcatcgcgatcatccgccagcgcgccgaggcagggctgaagaagtatggcgtgagcctggaccgcaaagacctcacggcggcacagtggttgcggcatctgctcgaagagctgtgcgacggtgcggggtacgtgctggcggccgaacgcaaagcagtcgagaccgaaaccgcgatccgcgccgccatccagttgctcgtgctcggcgacgcccagggcgcggccgacgtgctcgccgcatgcctgcctgacggggacgccgatggtgagcctgtcgtgctgatccgagacgcaggcggcgcatgagtgaccgcaactacgcggccatgcgcgccgccgcacgtgacccgccgcaggcgtgcatgcatgccgccgccaccgcagacccgtacttcaacgagagctttccaatgcccctcccgccgcccgagaagcgccgctacgaacacatggctccttaccggggctacaccatcgcgacgtacaaggacatgctcgatgagccggtctacaccgttgagggcgtgccgatcttcgcggtgtacttcgcgctcgatgagttcggcgactccatcacgccggtcgatacctgcttctggtcgccgttcctggcccgcgcgatgatcgacatctacgtcggcatgaccgagggcgaacgcaagacgtggtggaagcggcaaggcgcgtggccgatgatccaccagaactacagctcgcaacaccacctgccgatgctgctcgacgtaatgcgcggcatcgcagcggagtgctccgaccctgacctcgacatcctgttcggcgatgcgagcgagttcggcaagcacgtggaaaagcgcatcaaacagggtctcgacaccctgcacatctcacccaaaccggagtaactgcaatgcccaaatatcgcatcgtgaaagacggccgccacgttggtgacatcgaagccgaggacgcgcggcaggctggcccgctggccgccgagaagtggggcgacggcatgtacgacctgtcgctgatccgcgaagtcgaagacgacgaagaggccgagtgatggacgcggcgacggcgctctggattctctcgaacctcacgctgttcgcagccctggtcgcggagaagcatcgcaaccggaagtaccgtgaggcgatccacgggttgctcgcggacgagggctacgtcgaaggcgagccgcaggcgtacatcaacgagacgctgcgcatgacggagcacatcggcaacccggaaccgagtgctcacgacttcgcgcacgccctggtcggccagaaggggttccgcaaggccatcgcacacgaagagctgcatcgtgtgtacctcgaaacgtacggacggggcgcacgcaatgggtgaactgccgcgcgtggggacggtcaggctctaccggatcgacggcgaagagatgaccttcgaccagattcaacgcaactgcccgcacgtcacggaaaagatgctgcgggaccggctgttccgaggggagcgaaagatggcccggctgagccgtccgccggattcgcggaggggtgttgacaagccccggagctggcgatagagtggccccgcagtagcgattttacttcggactccccaccgggtaagatcgagctgcaacgagacgggccgaggccagtctcccggtagcacggaagcgcgccccctcgcgacgaagtgcaaacccggcgtccggtgccacgatacggcaccccataattctcacgccgagagacaacatgaaaatcgaaatgcaagacctgccgaaagtccgcgacgcgctcgacaagttgatcctcgatcagcacaactaccgcaacctcaccacgcacggcgaaccggaagacaagctgcgcgtcgtcggcgagggcggccaccacgagggcgagctgacccgcgaagagctggccgaaatcttcgagaagcgtatcgaggaaaatctgaagttcctccgtcagcgctaccagatcgacttcgcccccgcgccgcagctcgtcactcgtgcggttccggctccgaccggcggcctgaccgaagccaacgaaaacgatctggacgccgaatgaactaccccgtcatcccgaggatcgcacccatgactgcaccgaaagtctcgcgtcgcttctacaacgcgctgcgcctgctcggcctctggttcctgttcgtcgccgcgttcaagcagtacgcgcgcttcatcaagccgagccgcgtcatcaccctggatggcgtcaacggcggcgagcgtcgaccctacctgacccgctggcacctgatcccgcgcaaccgctggctcaacctgtacctgcacaagttcgtccacggtgacgacgagcgcgctctgcacgaccacccgtgggccagcgcctcgctcattctcgaaggccgctacatcgagcacacgagcgagtggttccctgcgttcgataacaagcagatgggcgcgtacgtgatggcgatgagcgacctgttctcgccgcaggacggccgcacatacgtcgagggcagcgtgaccgtgaacagcggcttgcgcgaaggcgagaaccgcttcgactacacccagcagttccacgctggcgacttccgcaagctgccgccgacgcacatgcacatgatcgagctgttcggcaacaacaccgagccgtgctggacgctgttcatgaccggctcgattgtccgccgctggggctttgcctgcaaagacggctggcgcgacttcaaggaatacctgcaagacagcccctcgcaccctggctccacgctgggctgcgagtaaccgaatcccgcaagggaaccctgctcgcatcccgcgagttgtcgacaacaacgcaatggagatacccgatgagcgccaccgctgaagcagtgaccgaagcaaccaagaaggcggcgaagaaagcccccgccaagaagaccgcaccgaagaagaccaaggccaccggcacggccgctgccaagccgcgtgccaagaagctgatcgccgccaagaaggccgtcaagaaggctgcgccgaagaaggtcgccgccgatgctccgaagcgcggccgcccgccgggcaagaaggctgcgaagaagaccggcgtgcgccggggcaagaagggcgcgaagcagttcgcctacctgctgctgaccgcgcaggaagacggcacgcagaaggcaggcggcatgcagggtccgttcatcaccgaagccggtgccctggaagacgcgagcatcatggccgacgacaacacgaccatcgtgctgttccgtgagaccaagcgcggcaaggtgcagaagcagaccaagttcgtcgccggtcgctaagtcggccttgaccgagtagtacaacgagcggccctgtcgaataccggccgggtcgctttttcatatccgcagcaaggacactcatgaaagccgacatcaatatcaaccgcagcctgcgtcgcgtgttccgcacgtacgacaaggagaagcagctcgaagcgcaggggaaggaactcagcccgtggcgcaagaagcagctcgcggcagacgagcgccgcttgttcgagttgcagcagcgcgacaacgagaccgacaatcgcgccgacaagcgcggagtgccgggcaagccgggcaccggcatcttcgccacccgcgacaagggcagcgtcgaagagaagctgcgcaaggcgttcggcggcaaggtcgccaagcgcatcttgcagcgtgagcgactggccgctcgcgagcgccccgaccacgtgcgcatcttcgtcgagcaggtagtcgacggcgtaggctcgcgtacggagctgacgcgcggtgtcgacttcgcggttgtcccgccgccgcacggcgagccgacgctggtgctgcacgacgacgcgaaggtgttcgagattgagtacgcctccgactttccccacaccctgacctgagagacccacatgagcactctttctctgaagcgggaagaccgactggccttcgtcaacgccgcccacgcagcggccgcaggctacgccgagttcaccgagaccaccgcgaagtatccgaccacgctcagcaccgttgcgatcactgcgggcgtcctgtacgtcgccctgggcatcggcaacgaggtcggcgaactggccgaactgttcgacgaagaagcggtcaagcccgactaccgcgccgaccgatacgcgaaggcgtggaaggagctgggcgacgtgcagtggtacatcgcccgcatgtgcgaagagcagaagggcctgccgccgttcgccatcatggtgcgcaacgcagccacgcgcctcgccgacgcgcactaccgcgaagcccggatcagtggcttcgatctgcaatcggcgctctgcactcacgcgggcatcgtccagggtgtcgtcaagaaggccatgcgcgacggcatgcagtgggacgaggccaaggccgccgcgaagctggaagaaatgcggcaggcattgcagcagatggtcaacgtctcgttcgagttcgccgagcgcaccgcacccctggtcgactgcggcagcggcggctacgtggcgttgctgaagggcaaccgcgacaagctggccgaccgcaaggagcgcggcgtgctgcatggggacgggggcgagcgatgagcgcgcgggcgtatttcatcggcggccccttggacggccagcgcctcctgttcccggcctcgccgccgccgcagctctactcgcatgaagtcaagcaggaagagctgcctgtcggcgatccgaccccctcgcaccggttcgagtacgagaagcacttcttcatggatgcgatggacagcaccaccgtccatttctacgtgccgctgggcaagggcgcatcggccatgcgcgatttgctcgaagcgcggctgaaggagaacgccgatgggtgagtaccacgacctgacgatcatgctgagcctgccgcgcagtcgcagcgcgtggatggaagcgttcgtccgcccgggcaccggccacggctgcgcgtctctgcacaacccgttgcagcagtgcgcgtctatcaacgagctgggcctggttgttgacggcatgccgcccggcccggctttcatctccgacgtggccgcgatgttctttttcgaccatctcgtcgtgcggttccctggcgcaaagttcctgatcgtccatcggcctgcgcgcgaagtggcgcacagcatggagaccctgggcatcacgccgccgctcgatctgcgaaaggccgagaagcagctcatcgaaatcgccagcagcatccgtcacaacccctgggtgcttaccggcagtttcttcgagctgcataacccgtcgctgctctcggccatctacaagttcgtcaccgggaaggtcgtagagccgcgccacctgcacgcgatgatgaagaccaacgtgcaggtctcgctcgaagaacaaatccggcgcactgacatccagaagcagcgcatcctgttcggcaaggccaagatcatccactaggaggcaccatgaaaaccatcggcagcttcgcaggcccgtatcgcttcctctcgaacttctggtcgtgcgctgtcgttttcgacggccactcctaccggacggtcgagcacgcgttccaggctgcaaagaccgacgacatggacgaacgtcgacgcatccgtaacgagccggacgccgcaggcgcgaagcggcgcggtaagcgcgtagtgctgcgcgacggatgggaagagaacaagatcaacgtcatgagaaagctgctccgccagaagttcggcaccgagccgctgaagtcgaagctgctgaagaccggcaacgcaaccctcgtcgaaggcaattggtggggcgacaagtattggggcgtgtgcgacgggaagggcgagaaccatctcggcaaactgctcatggaaatccgcgaagaacttcgcatcgaaaaggaacagcacaatggctaagcgtattctgatctgcggcctgcccggctcgggcaagtcgaccttcgcgcgggaactcgccgcgcgcctcaacgccgctcacgtcaacggcgatgccgtgcgcgaggcggcgaacaattgggacttcacgctggaaggccgcatggagcaggcgcaccgcatgcgcgctgttgccgacacgcacgaaggtctggttgtgtctgacttcgttgcgccgacgccggagattcgcgcggtgttcggagcggacttgaccgtcttcatgaacacccttgccgagagccgctacccggacaccaacgagatgttcgtgccgccggagaacgcggactacgtgaccgaacgttgggcggacacgaccgagatgggtcacatcgccgaggcgatccgcttcatgatcccccagggtctcatgatcggtcgctaccagccgtggcacgcaggccacgcggcgctgttcgagcaggtgctcgcgaaggaaggctacgtcggcatcggcgtgcgcttcatgccgaacggcccgagcaacccgctggacggcgtagcggtcaccacgcgtatcgaagccgcgcttcagcaccgccggggctgcttccacgtgttcccgatgccgaacgtcaacggcgtgtactacgggcgcgatgtcggctacaaggtcgagcagattcgcctcactgaagaaatcgagtcgatcagcgcgaccgcgatccgcaagcgaggcggcgtatgaagtacgtcatcctgaaggccacgttcgccgacatggacgtgagcaaggcgttccccttcatcttctccgagcacctgacccactcggaaatcgccaaggcgatgaagcggcacgtcaccatcgagcttcgaccggccaacgtcgaggtcgaagtccacagcgccgggttctgcaacgtcactaaggacggcttcgtgtgcgtgcggggcagcgaaacgctgaacatcaagaaggaagagacgcgctgtgccgatgacgagcgcacgatcaccttcaacgattccatgagcatcatgctgtaacaaccggagccgagtgccatgcgcgagatgtatcaggaaatcacgttcaagaagaagagcctcgaaatgatcgaccgcatcaacggcatcattgaggtctatcaggacgaaggctacacgctgacagtgcgccagctttactaccagctcgttgcccgcgacatcattccgaacaacgagaagtcctataagtacatcacccgcctcgtcaacgatggccgcatcgccggtctggttgattgggacgccatcgaagaccgcacgcgttcgttcgaggcgcgcgggcgttggaataacccgaaggacatcctgacggccagcgccaagcagtaccacaccgacccgtgggccgcgcaggaccgccgcattttccttgtagtcgagaaggaagcactggtcggcgtgttccaaaacgtgtgctggaattacgatgtgccgctgctcgcggcgcgcggctacccgagcgcatcggttgtgcgtgatttcgcgcggcgggaaatcgaacacaacgccgacaaggacgtgctgatcctgcacttcggcgaccacgacccgagcggcatcgacatgacgcgcgacctgatcgaacgcttccagttgttcggcctgggcggcgagttcgagttgaagcgcatggcgttgaactacgaccagatcgaagagttgaagccgccgccgaacccggcaaaaaccacggactcgcgtttcgtgaattaccgcaagcgatttggcgaatcgagctgggagctggacgctctgccgcccaccgtgctgagcaacatggcccgcgacgaaatcctgagccacatcgacgcggcggcttggaagacgtgggacgatggactgaaggagacgcgcgagaaaatgctgaagcacgtcgagaagttcaaggggtaagccatgatctacatcatcgccggagacgacagacaggccgaacagtgcgccgacatcaaaggcgcatcgcgcggcgagtggaagcgggtagcgagcctcaacgacatccggggccgccgctgggacggcatcacggtgtatgcgttcggtacgttccgcacgcggcacatgttcgagtggcgcgagatggtggaggcgctgcaacacctgggcggcaagttggaacaggtgatcgacggacgcttgacacgctgacccacgcggccttatggtcgagtcgtcgaagcgatattgcccttccagccggaccagcgcatagcgaaaaccggaatcagcagaaccacgcagtcgacacccggccaccgacgagagtcgcgccacccccggaaggccccgtctcagcaacggggcctttcttttgcggtcaagaccaaccggggcaagaccaacttggccttgaccgcaaaagaaaaccccgggtgtttagtccggggtttccagttgcaggctgagcgccgattctcttcctgcgttccctaccgaggtgccgatgcaacgcgaagtgcgaccagcggccctaaagctatccccgaccgccggggctgtcaactaccggcggatcgcccccgccttctcgtacccgtccaggcaacgctcctgcacggccgccagggcgcgttcccgcttcaccgctaccagcgtactggcaacccactcggcggcccgtgcggacagccgggcgaggccgttgggccgttcgggggtgggcggcacccactccacccactcgtcagccgccggtagggggtccaggggcgtcgaggcggcctgtcggcagtccacggtaggcggtgccgggcgaacggcctgcgtgcagccgcacagggccaccagggcggccgccagcaccagggcgcgggcggtcatggcacacccccgttcgcgtccttccagcgggccagcagctcggcctgcaccgccgggtcgaccgggtggacgcagctaccggggctgaccggcttggtgacgatccggtcgcggtagacggttcggatggtctcgacggtctcgaccttcgtctgtccggcctgctgctcgaccgccgcggcttccttgtccgcctgctgggccacgtcgcggcccttcgcctcggtcttgatgtactgcgtgttgccctcggccttgcatgcgtcacgccccttctgttcgtagtgcgaggcgaagccccaccagcagagcagaatcaccacggccaggatcaacccctggcccagcctcgtgttcaacaaccagctcatagaaccccctccggccacgcgggcaacgggatgttgttggcgacgagcaacgcacgcagctcgtggatgtagaccagtcgtttcgctgaaacgtcgtcggccgcctgcgccatcctttgcgcgtgggacgctgcttccgatgcgcgtgcggcagcggcttttgcagtgtcagcttcgatgctcgccatgttggccgcgcgcttggcttcgccgatttcgttgtacccggcggcggttttgttgaaaagctcaccgagttgttcttccagctcccggttccgcttctgcaaccgctcgatcaaatcagtcttggccgcgttctcggtgtcgtcgagaatctggcccgagcgctgcctcttgatgacccaaccgacgccgccggtcaccagcgttcctagcagtgccgccacccacttccaggcgttcgtttcatccaccgtcaattcccctgtcatgttgtcgaccgcagcttccagctcaacgtccatcacgctgtttccagatcgctacgagtcgcctcagtacggagcacgcagaaaacagccatgaccagggccaggatgtgcgtgccaaccaagccccgccagccctcgaaggcggcataggacaggcagatgataaaccaagtgaacagcgcgaacacgttggaggcccaagccagccacgtcaccggccgcgtggagagcacgcgccacagcatgagcgacccgctgagccatagcattgccgaccatgcgtagaccggcagcgtggcgaacagcgcccaccgggtcggggcgggcatgggccggaccagcaaactcgcgccgaagatgaggctttgcagggcgagaatgaaacgcaccttcagcgtcgtgccttgggtgatggcgtgccacaagtcggcaccgattcgcggtttgatttccatctcagtttcctccgaattttctatgggctgctgcaagtttcacgtcgtattggttcttgcggtactgcgagccgttgtactttctcgcgacggtggcccaatcgccgcgcttcaaagcattccacaactcggtgtcactctggatgaacgccaccatgaggtcgagctgcgcgccctcgctgcggaacatgcggttgatgaaatcctgcaacgatgccgctccgactttcttccagttgttgcccaggatttgcgggatgccccagctcgttgcgcgcagtgcggcgtcgcggtcgagcgccacggcctgttgcagtttgccgtgctggctggcgtagctgctgtagggaaccgcgccccacaccggattgctcaggtgcgggtggctcttgtcgaagcggccgcccgtgtactccgagaacttgtgcggctcgaacaggatcgtgacctgcccgtcgtcctgaaacccgccgcgtggcgcttcgacatcgagaatggcgcgcaccttcgcctgggatacaacaagggccttggctgcgcgtgcgatgtcagcgtcggtgagcttcttcgagtcggtcatggtgcttctcctgattaattaagggccgggttcggacgtgaggcgatcccacagtaccgagttctgcatgatgccgccgtccgagtcgaaggcgattccgtagtacgcctggacgccgggcatgaggttgttgaactgcacgtagccgttcgcatccgagagctggatgtcgatcagcgtatgcaggcggcggtagaacaaagcgacgcgcacgttctgcaacggcgtgtcttcttgcgtatccgggtctcgctgcatcacgcggccgcgcagcttgtacgtcggcagcacgttggtcgaccccggagcgccccaccatggcgggacacctcgcgtcgacttggtggtctgcaccttccgcaaactggccggaggcgcgcgatagacctcgatcttcttgaccgaatcaaccttggttactttgtcccagccgatgcggctgcggcgaatgaacgcggcgaggcgtgcgggtgcaggcggcgggtcgatgacgttgatgtagacgttgcgaatgccgcccctgaaaatatacgagaagcccaagtacaaacgaccgccgattgcaaacgtgctgaccgcgtagttgtagttgcgggcgtgaggcaccgacgcttccactgcgccgtccaccaaaacgctcagcacaccgtcccttcgacggaacagcacggtgtgccagttgccatcgttaaccgcgctcgtcgtaccgattaccggcgattcgttggggccttccgccgtccagatcaaacgcccctcggtgctgaaatacacctgccacgtgcttccgctgccggtcaggtagtctagaacggtggagagcgtactgctcgtagtctggatgtcgaaagcgatgtcgaaatctttcgtgccgagcaggaaatcgccgccgctgttcgtgtagatcagaccgtcgcctataaaacgcgccgctccgtcgatgatgatcggagcgacgctgtagccgctccaaaatcgacctgtagcgtctgcgtacgaagtcgatccttccggcgagcttaggggtaggttggcgagcagcatttcagtttaccgatcccaggtgtcggagatttcaaacaacgcggagttctggtagtgcacccgatggaggaactgtttccctgccagttcgccctggccttcgaccaacgcgccatcgggcaggattccgaagtagtggcagtgaacccaaatgccgggcatgatcccgcgaatactgtagggtccgacattcgggttgtgcgcccacaccggagagaggtacagcccgccgtcagggccgtgaggatagctgaggttaccgttgccccaactgctgttgcccttggtcatatcgttgtgccagccgagcgtgatcgggccgcccaggttggtgaagtcacgcgcaaccgaaaggcggtagcggttcatcgccgaagaaatgctgtaaccctggaacggatactgctccgaagagttggggctgtcgggcgagtcgttctgcaacaggatggtgtgcgtggtgtcgcccggcttgaacgggatgatgtcgccgaacgcgtagcactcgcggtaatactgcgtgccgctctccgggtaagtggtcagcaacaaccagaagaacatctcgtctgcgataatcgtccacgggcgggggttcgccaccgagccgctactgtagtgggtgaaccaattgccgccctgcgggttctgcgcgagagtcgggaagggcgacggcgagccggtgttgacatcggtcatgacctcgtagccgacgaccttcgccttacggtagctggtggcggtgctggtgtcgtccacgcgcaggtacatgccattggagccagggccttgcttgaatgcggccacgttggtgccagcgaacggcttcgtccagcccgcgcccgccttgctgccgtagccggtgacgaggcacttttcgagcacgttgatgaggtcgccgggcgtattgccgcgaaggaccggagcgtctgcgtcagaagaggaataaactcgaacagtcatttcagaacctcacatagtcaagagaagcatgtaggaagacttgcgcaactcgttgccacctccgtcatcgtcagcaccgaaaatccactcgatgttgggcgacagcggcgggttgtactcgttgcccttgaacacccaaacgatgttgggcgatagcggcggggtgtattcgtcggccatcgtcagattccatccaccacggcctgcacatcgtagaagccgtcgtcatcgtcgtacacgaaaccgatgcggtcagactttcccggcgtggaagtggcgttgtaggtcgagatgaggttgttgaatcgaacattgttgctgaaggtaaccgcacggccgccaacagcgtcttgcttcagcaacagaacgcaaccctggccgtccagagcaccttccatgttgatctgcgtgttggccgtgagcgtcactcggatttcgtcgtacgagttccagtcgcagatgaccgagccgctggtggtgtcagtgattctctggatgcgacgctgcgatgggatgccgggcggcccctggataccggggtcacccttcgcgcctttcaacgacgccagccactcagcttgcgtaccggcgaatccgttcgccaccgccacctgatacgcgctcaggccgttcgcgccggttgcgcctgcgttgccttgcgggccgcgcagggattcgagcgacacgaggttgatccagttctcgtcaccgacgtagcgccagcggatgtagccgccgcccgtaccgatttcgatcagccgcccctcgaagaaaccgatgctgttccagggcgtcacgccgtcgccgatcttgaacttggtctcgtccgaagtcgcaccgagctgcacgccgatttccccggccgcgaggaccgggttcttcgattgccagttcgccgctacgtcgcggcgctgccacatgcgttgggcaacaactacctgggccattacgcgccgcctccgtcaagaacgtactccggctcgtcgaccgcgatggtgttcgtgatcgtgccgctggccggagtgtagctgaagtaggccacctgcttcgaccacgaggccaggccctcccgcatcgactcgatttcgatgcgcatgtctcctgctactgcgaggcggatggtcgcggcggtagcagcgtcggagaccgcaagcgcttctgccagtagggcgttcgagccggtgtagacccggatgttgtaggtcgtcccttcctccggcgtacgtgacggatcggcctgggaggcgatagtcccgtccaggcggttgcggtgcgcccaggtcaagatcatgtccccggtgaaggccgatccagcaccgaccggcgcggcgttgacccggattcggcccggcggcagcggccgcagagagcgcgagttggtcgtgaccgtgacggctgctgcgaggttgatgtcgagcgacgacgacacgttcttcggagctagcttcgtgttgaccgtgacgttgcccgagtagccgtcgacgttggtcgtgcccgcaccttcggacaggaagaacacgcgtgcgccggtagcgtgatcctgcgggatggtgtcgagcacagcgcggtacaccccggtgatcgtgaacgtgccgttgccgttgtcgacgatgttcttccatgccatgagttcgttgccgaccagcagcaggttctcgcctgcctctcgcgaaccatcggtgcctgggtcaagaccggtcagcccgatggccgacgacacggtgaagcctgcggtgtcgacttccgggccagtgcgcgacagaccggccaagagaacagcagacggcgtgtagccctcgaccacgttggtgatctggtaattcgacgcgccgctggggtcgctccacacgtcgtagccgatgacgccgttgctcgcgggcacgcccatcgtgatgagaaagcgtcggctcatatcgtcagcgccgaatgccggggcttcgatcacgcgctgcgcagcgaacggtgcgagagcagtaaccggcggaacccaatcacccggacccggcggcacgtacgctacagcgttgacctcgaagatgtcctccatcgcggtgatcttgatcgccgggtcgtccagggtgccgtagctgatttcgatcacgcgcatgagcacgttcgccagtccgcgatccggcttgcgcagccagaagccggagccgggacgcagcttgtagccgatgcggttgagcgacatcttcgccgagaccagcggcgacgctttcattttcgacacgcgagcagcggtgttcatcgccgcagtgtcattgctgaagccgaggtagctgaaggtctccgcgtcgatcatgccgccgcgcacgtcgatgttggcgaggtcttggtactgcaccggcttggtctcgaacgaggcgcggtcggtgtactcaacgatgatcgtattcttcgtcatctcccaggacgtgcgcgagaagtcgaagctgtcttcgaggatattgctgtcgtcaataaccagcaggtcgtccttctcggcctgcgagaactcacgggccagcgtcatcgtgtacaggccggtgaccggatcggcgtacaccacggcgtcagcgtggcgcagcacttcggccaggaggtctttgccgagcatggccgactgcaccagcatcgaaatgcccagcgactcttcagccagcaggttgccgcaagcgcggaacgagtcaacgtcgatcttgtcttcagggattttcatgccccacatgttgttggtcatcaactcatacgacgcgcacgcgatattcgcgtcgccgttgacgttgtggcggccgccggtcaggccgagctggttcgggcagcggcgagcaatgatcgagatgggcggcggcgtgtcgctgttgccgaggtagcacttctccatgaccatatgcaccaacgggcggaacgcggacatgtccggttcgttccactggccggagaggtagttgttcgtgccctgcgtgaacgtgccttggtacagaacgcacttgccaactacgccgctcggcgggtcgccgttgtcgagaatggacggcgagcagatgtagaactcgcacttgtcgccgacgaactccttgctcgcgacctgaccggccagccacgtgtccttgtacttgaacaccgagcgcacaaggtcagccaccttgtcgtctacgcgcagttcgatgaactcgtctgccgggccgtagccgaacacgagctgcacgcccaggtagtagttgtacccggtgacgatcttcttcgacgagaaccagccggtcttgaccttcttcttcagcgtcacgacttcgaggtcgccgaaccacaccacattcggccccatcatcttgcaggtgccccaccacaccggtacgacgcgcgaggcgtccacggtggggaacttgaagtcgcccacggccgatgggttcgggtcgttgaacttctgcttcggccgcagcagctcgccgacgattgcgacgacgattgcgacgataattgcgatccaggccattaggtgatcccctgctggaagacgttgtaggtcgggaagtgatcgaacccgacgtagttgatcttgttattgaacttgcccgagcagacttccttcgtgcgtgcgcagcctgcgtacacgtcgagaatctgcccgccctgcaccgtttggaacggatacacgaccttgatcgtggcggtggctgcgtcatgcgccgtgatgaaacgctgctcgccggtctcgcggtcgacgatgaagccgttggtgtagtagccggtcggcttggacgcgaactcaggcgagccgagcgtgtagccgtccacggtggtgatgagcgcatcacgccgccacagcgacttgtcgacgccgcaaccgatctggtacagcgcccacacgcaaccgaccttgaacaccacccacggcaccgtctgcgaaaggttgtcgatgatctgcgagcattgcagcgtcgcgtcagctcccttctggctgaagctcgtcacgaagccggtgaacgcctgcacgatttccgcgccggggtcattgcgctggtacgcgtagatcgtcagcttgatagggcgaggcggcagatacggcacgtgcgcggccgccacggggttgtcgaacggcacgacgacttccaggctctcgacgttggcatcgcctgcggtctgcttcagctcgccgcgtttaatcgcttcgggcctgtaagtaatcgggccaatcgagcgctcccgcgcatcggtggtgtacgcccagcggtaacggccgtcgtcgctctcaaacaggtaaagctccacgcgagagccttgttctttgctgctttcgtattgggccagagacatatcagtcctcggtcatcttggcgaccagcatcgactcgacggtggccttggaatcggtcaggtagcgcaccgtggtggaaggagactggaagcggtacagcgtcaaaaaactgatccgacgaatatcctgcggccgcacctcttcgccgagcgcactgtcgagctgcaaccgggtcaggttgtcgaactcgctaaccagcgtaatgcgacgacagaaataccgaccattcttcaacaggatgaagatgtcgcggcgagcaggatgcgcaccgaccagcttcgcgtattcgttcgactccaccacgagcgagttctcggtgtcgaggatcgtcgccgccatcgtgaaatcttcggtgccgctcggcatgtagaccgaacgagcaacaccctggcgacggccgaggaaacgacggaactcgaaaatgtcagcgcggtcgaacagcgtccagttatggcggcggctgattttcgagaagcccgaggtggtgaaggcaacgaacttgcctgtgccggtgtctacgcgcttcgtgtccgcgctgaaggagaaaggcatcgccgacagccagttggtctccttgatgtacagctcgtgccctcggtaggtcatcgggtccgggttcatcgccgcgttgcccggcgttacgctcggctcgaagtcgaacgacatcgccatgcggccaacgcgggaagtctcgcgctgctcggacatctcttcgctcatgaggccaacgaaacacggatacacgcgcgagtcggcaggccagtcgtactccaacccggtcgtgaccgaaacgccgtcagcagtgacctgctgcacttcgcggatttcgttcacctcgtcgtcgagatacagcgccaccagcgaaccgggttcgagcgacaggccgaaggtgttgaaggggataacgagcgagcccgcttcgacggctgcgtcggtacgcgactcttcgccccaatgcgggacgccgaagaagcgggcctgccatgcgaacagcagattctcggcgcgctgggcctgcttagaagtccgcagattgatgttgaactccaacgtgcgtcgcggcacttcacccgactcgctaccggtctgctcgctaccgtcgtccgacgacagcacccacgagcgatgcgtgatcgtctcgtcgaccggagacccccaattcggagagaacgggaagagaacgatgcggcggccggtgatcggcacggtgtagttgacgccttccacggtgaagcgcgcatagctgctgatcgtcggcgggcctgccagttcgatctgaacggtgaaatccagctcacgcagcggcggcatctcgaacggaatgctgacgcccgccgggggagacatcgaaatgcctgcctgcgggccgagcacggccgactccaacgtctgcggcgtgacgtaggcattccaaaggatgatgtgccggacctgcgtggacagcagattgcccgcatccagggcggccgggacgatgaagatgcggttgtagtagtcgtcgaagaagctcgtcatcttgcgctgcgccgacacaccccggtggttgctcgaatgcacgtgccagctaccgtagcggccctgcaagaagcgaccgccgtcgtagctgtcgaacatcgacacgacttcagtcagtttgttgaggtcatcactgagcatcgggttgtcgatgccccgctcaaacgcgctccccatttgtccgatacgtgctgccatgtcacggccccgtgtagcgaatggcgtaggcaaacgtgccgctgtgatccgcgccggtcgaccacggcacgccgttgcgcactgctgcgttcttacggtggaacgggtacaccttccagcggtcggtgccgtaggtcacgatttcgccggacaggtggttgtcgttgcgacacaggcgcgcgttttgcaggtctgcggcgatagtctgccccttcgagagacgacgctgcaccgcgagcaacggcaggagcacggtgctctggttgaactgcgacggcagcgattgcagcagagcggcaactggatcgccgctgcccatcaaatcaccttcgctggtccctacgcgcttccacccggttgagtccaggccagtgtggatgtaggagcagcccaggggcgcgttgtatacctcgtggaacaagccacaccccatgccgctccacccgaagccgacgtagctatccgacgcgttggtgtacacgagatgggttgccgcctgcaccacgtcactgcggaacgaaccggtgagccacatgccggtgccgccgacctgatcgacgcgagacttgccgaacgacaactgctggtacttgtcgccgttgtaattgatgacgaggtagacctcatcggtttcctcgaacacgtgcaggtcataggtcgccgggaagttcatcggcgagccgctgaagttcatgattttcacgccgtacggagccgcgcccggcagagggaacgggtcgacggcgctgccggtgcctgcgaacgctgcgatctggtagatgtcggtcgccacgaggcggacgtacatgccgttcttttccagcgtgccgtcgccgttgagcgcccagccgtggttctgaagcgccgcttccatcgacgccttcagcgtcacgaacgaagaaaaattgccggtgtagaacattaggtcatctccaagccgatgaagctgcgccagtcggttcgacccacgtcttgcagcatcacgaatgcgcggccgcccgccgcaaggactgcatcgacgtgctcagccacggtcatgccggtgctgtccaccgcagtgccgccgacctgcaccacgttctccacgttgttgttgaagccggaaatctggtacacgccgtccagctcgccgaagacatttcccgcgtaggtgtcgccgctggccgtggtggtgtacaggatgatcggctgcggctggtagttcgttcctgccgggaccagggagcggtggcttacgtccgtgtccaagtagctgtagttcgccaacgcgttgtagccgttccacgagttcgagccagccgcgccgttatagaacgggaaatgcgagaggcgacgccacgtgcctacctgatcgcgcagccacagcagcgaaggacgctccggggaagacgcgccgctctcacgaccgtgatacgggaacgcgtagtcgaggtccgagaatcgcttcgccgctgcgccgtcgaacatgcccgcgcacaccagcggcgaggggaactcgccggggcgggaatacgggaacatcttgcctgcatagaagtgcgtgtagaccggcgtgccgactttgaagcaaccggcgatgcgctgggcgttggcagtgatgaagtaggtgacggcgttgttatggcacggcacgccagaaagccgcgcgcccggctgagcgtcgaacgtgttagccgatacgaagccggtgaacacgcccacgaggatattgtagtagtcgccgctcgtgctgaagtaggtacggaagccgatgtagatgtcctccgttcccgacaagcccttcgagttcaaaatcagctcgcggttcgtgcctgtgttgacgtagcgcagcgtcgtccatccgttcgcttcagccagggtcttgatcgcagcgagtaccttgtagtacgcctcgtcgccgctgccgcccgtaacagttccgattgcgtgtcccatgttggttcctttaattgcccaggagtttcttgaaggaggctcggtcagccttgatgacgttgaagatcgcctgacgaccagcgcgggtgttagcaccggccgcaaccacgctctcgctgtcgatggtgttgatgatagacaggtctaccggggccgggccgctgccgccagccatgccgccgttgaagcggtggcgcggatcgttttcggtcaagacctcttcgttcttcttcagcaccgccggtacttcgtcggccgcgaagcccgccacgccgcccgtgtggtagcgcaccgcgctctcgtagacgtagctcggcaccgcacgcttcttcgacgccgcgccgaccacaccgccgtcatgcttcacgtagctcatcgccgcgttgatgatcgcgccccagccgccgctcgcgctctccgaagcctgcttcagcgcgttgaagatggcctgctggataatcatctgcgcgagctgcacgagaatgtcggcgatggtgttgagcacgatgtcgccgaagctcttccatgcgtcgcccgcactctggatgcccttcaggtagtcggacatcaccgccgcgctctccatgaaggcgttcgtgaagccgttggtgaacacgtcgacgatcttccgcttagtcgccgacatctcgaccgacatcgccttgatctgcgcattgaggttttcgaggttcgcgcgagcagcctgggcctgtgggccatcgcccagcgtagccatgaactcgaccgccttcagtcgcagagcttcgagctgcggcagcagacgagcgttgacctcttccatctgcgcggacgcttcgcttgccgtcagcagaccggcttcctgcaaggtgttgatcgtgtcgatggacgtgctgcgctgctgcaacagggtgttgatgcgagcctcgtagaactcctgctcggccaactgcttctgctgcttttcgaggtccggcagtgcgtccaggccgcgctgcgcttccttcttcgcatcgggcacgtttagcttttccgcctcgcggatcatgcgctccaactctgccttgcgatcagcgatcttgttgtcgatcaccttcagccggtcttccagcgtatccgggcgcgcctgggcgatgtcgctgtcgatgtcgcgcagcttctcggccacgtcttcttccaggcgcacacggcgctcggccagggcggcgaggcgcttctcttcggcctccttcttcttgcgcgccgcttcggccgccttcgctgccttggtgtccgtgcccgcacgctttgccgctgcgtccgcctcggcctggatgcgcttgaactcggccgacagcgcatcgttctcggtcgcggccgccttcgacttcgcgatgccgaggtcacggctggccgatgcgaccagctcgcgcagcggggccgcacggcgttcgaggttggcgagctgcgcctccatcgccttgccctcggcctcgacctgccggatagcctcgaactgcttcgacggcagattggcgtcgccttcccgagtgctctgcgcagtgcgaatcgcgacctgattcttgcggatggtcgtgttctgcgcgatctgatcggcgaggttcttcttctgctcatcgtagatcgtgagcaagcgctgcgctgcctgcacgcgcttttccaactgctcggtgttgtcgcgcgacagaactgcgaggtttcgctcggacgccgcaaaaccacggttgagttccgtgacggtcttctgcacatcgagcttgtcgttgttcgacttcagctcgcccttcatctggaaatagatcgggatgatgacgcccgccgaagcgattgccagcagcgccgcgatggggccgccgatcagcgccagcagcgaagcgcctgcgcgaccggcagacgcggccgtgcccgcaccgagcgccgtgttgagcgcgaccgtggctgcacgggccttcaggatttccgtagcgagctgagtgaagacgatggcgatgcgcgctgcctggatcgccagcatgatcgcgatcagctccttgaagttccgcacgaggaaggcgacggtgttcgctacggtctcgatcaggccgtcgtactcggcgaatacgtcgatcagctccttgcccgcttcagcggccgcgacgaagaccttcgtcagattcgcagcgaacttcttaccgtcgtcgctcttcaggaacttcgtcagatcgacgaacaggctgcgcagcgcagtaccgaggccgccgtcgatgatttcacgcttcagatcgccccacgcgttcgacatgcggttaatgtcgccgagcaagctgttcgatgcggccttggcctgcggaccataaataccgcgcgcagtttgcgccgccagcagcacgaactccgccttaacctcgccgcccttttcgagcatcttattcagctcttgcgtcgacacgccgatagccttcgcgaacaaattgaacgcgccggtcatgcggtcgccgagctggccgcgaagctcttctgcctggatgtagcccttcgagaaaatctgctccaaggcgcggaacgcgccctcagtctcttcgccactcaggcgcaggaccgtcgccgcttccgtgaacgactcgaagatataacgcgttgcttccgccgacataccggcatcgcgcgcagcaaccgagaaccggctgtacgaatccgccaacgggccgaaggcgaggcccagctcgtcagccttcttgcgcagatagtcgtattccttcgccgccgcgttggcgtcgcccttgtttgcgatcatgagacgcgacattgcgcgctcgcgatccacggcggcgtcgacgctttggttcaccagattgatcgcgccgaacacgcccacgtaggcagacaccagcgagagcacctgaccacgggtacgctgatacagcgacagcgcggtgcgctgcccggtgttgagcgcgttgagctgcttgctggtcttcgcggtcgactgctccaactgcgtcatcgtctgcgcgacctgcttctggccgttcgcaacgcgagtggcgttctgagcgaggcgctgctcgatgccgttgaggttttccagggtgatgcctgcggccgccgcacgctgctgcacgcggttgaacgcttcggtctgtcgacccaggtctgcctgggcctgccgcagtgcggcctgtgcgcgttgcagcgacgccgccagctcgtcgttcgggcgatccgatcgctccacggcttcggcgtagcgcagcacttcctggcgcgcttcctcgaaccgctgctggctggcggtcaaggccgtgttctgccgcgcgaggtcatcggcgagaccgccttggcccttcagcgcggcggccgcttcccgcaggcggcggctctggtcggccagcttctcgatgccgtcagcggccttcagggcgtccggcgtcagggcctcgaactccttgtcgagctggtcgacggccttttcgagctggtcgagcgtagcgaccgcctgcttggccggttccagcaccgcctgtacgcccgctgctgccccgcccagggtcgacccgctacccacggcaggggcggcggtagcgcgggccgcctgcgcagcctgcgtgccggtggcgcggaagttcgccccggcggccgccgccttctccttctcgcgggccagggtgcggtagacgttggtggtcagctcgacgaagcgctgctccttccgggcctgctcttcgcggtccttcgcggcctgggcaacagcagcggccgaatcgcgggcggcctgcgcctgctgccgttcttcctgctgcgcgagttcctgctgctgccgcacttcgcggacagcggtgtcgtagcgctccatgttgtcggtcgactgccggtacagcgccagcgagttgttgaccgcactgttgagttcctgctgcgactggctgaagcgggtcgtgtcgacgcccatctccttcagcttcgcgcccgacgtttccaggcggcgctcgttattccgcagcgacgcgtccaggcgagtgacttcactgccagcggccttcaactgctgggtgaactccttcgtcggcttctcggtgttgtaatactgctgcgcgagcgtgttgaggttttcgcgagcacgcgcgagttcttcgcggaggctgcgcacctgctgctcttgctgagcgtagccttccagcttgcgcgagcggtcgttgagcgacttcatgatagcgagcaacttctgctgctcgcccttcagactctcgaacgaccgctcggcgagacggttcgcatcggctacttcgttttggttttcggcgactttgcccagctcgtcattgagctgagaaatggttttcgtactgaggttcttcgcacgtacgatcagttcaacttcgttctgagcggccatcgcctatagctccgagatttgttccttgaatgcctgcgcgcccttcttgctgagcgcggagccgattgcgctttgaatcaaaaccgcttcagttctaatgcggttgttgacacgctcgcgcgcgagttccgtttctacgatcaacacacccagcggatactcgcctgcgagagcgtgtccttcagcggtcaggaaggagactgctgctcggattccgagccaccaccctgcgaatcgctcgattcgagatttttgtttcgcaggtgcggcaccacgctttttgctccgcgaagtgccgcttggacgtttcccaggaactcgcggaatccggcctcgtccttgaaggtaagttcggcgatggcgcgcatgcacttgatctgcgtcggcgcgtcgagctgcatggcgaccatccacgcttccggctcgtgcgcggcgtacgcgataacgcgtgcgatgaagtccggcatctgcaccatgagcttctggccgatctgcatcatgtcgacttcagcgaggtcggtggctttcttgacaccggcaccttcaacgatgtcgaagatttcttccatgttgtctttctgcgcgatgatgattccggccacgtcgttggcgttgaggccgaacagcacgatgctctgctgctcgtcatccgcgcccaggtacgggacggtgatggtgcgaaggcgaagggacgaaagggacattggcttcctcggttgctggcaagaaaacaggccgccccctttcggagagcggcctgtcgaagttggtcttggccttcttggtcttgactaagttggccttgaccgcgtttgacgcgccccggttacgccacctggggacggccgtcgatgtagacggtagcgtagccgtccagcttcaggatgtcgaacgcgaagctgagctgctgccattcgtcgcccttcagggccagatcgccgtccgcgcggagctgcacgtagggccacaggtagtcgcggcgcgggccggtcgggttgtaggagacgaagcgcagcgcgccttccacggtggtgccgtcgccgaccacgacctgcgagcgggtcgaggcggccgcgctgtagttgatggtgaacgcctcggtgccgtcgatagcgccgcccgggaccacgtagagctggcccagctcggagtcgacggtgtagtcctcgttgagcgtgtacgggacgggggtgcccgcgccatcggtgacgctggtgatggtcacgttgcgcacgccggtcgggttcgccagcgactcgccgatctggatgtaggtgcccggcttgacgcggttggccggaaccacctggacctgcgcggtgagggccgcctgcgccacgacgctcacgtcgcccaggaaccacagggccacgttgtcatcgctgatttcgtcggcgatgaaggtgccgctgtcggtcttttccagaacgatgctcttgtccttcgtgcgaatgccccggtcactgttgaagtgatcgaggttttcgctctcggtggtgaggttcagttccggggtgttgcccaggtaacgctcgccggtcttgttgcgggtgcccggtacgaacttgtcgaaacgcagttcgccacggccaagggtgtaattctcgctgcccattgtggtctccttcgggtggtgttgcaggggttaatcacgaatccagtacgggtctcccaccttctcgacgagttccattcggaccctcatccagaagtacgctttgtcggattgctcgtcgggaggccgaacaaccccgggttcgatggacagcgtgtttgcgagaccaccgaagaacccgtcttggttgcgcggggtaatcaacttccccagcgccttttttacgtcgcccatgagcagatgtgccgcatccgtctcatcgtcgccctcggccagtcctgagttgtcagcccagccgttgagcaggtaaatctgatcgtacttgtgcttctgcccgacgaacccgccgatagtttccggcaagcggtcggggttgaagttttccagcaccgccacgcccggcagcttcatctccttgccgaagttgcgcttgtcacgacgaaccatcgcgaggtcgaagttgtagccgttcgccagggtgatttcgctcttcaggtaatcgcagagcgtcttgaccagcaacagtcgcttcgtatcagccacggttcaatctcccgaagttgcggaggaagctcgattcgagtgcgtcacccaccgggccttgcacatcgaaccgaacatcacgaaatacttgatcgacggacggaccatacaacaggtagaggcttccgctcacgttgaccgcctgcttcttgttcaagccgccgggcagctctccctgcttgttgagccgcaccgcaataccttcgttcgagttctcggcgtcgtacacgccgttgccgcgccgcagcttgatcggaaatgcgccggggatgcgcttcgatccgccggtcgcggaaaccttgactcgaacgtagccgcctttgccgagcttcgcgccctgctcgaactgagccagagaggtcggccggtgacgaccggagatgacgcctacgaggtcgcctacgcgggccttcttcgctacacgcagtctcgcgcccggatcggtcgcgttgccgatgtagctcgccttgaacgcaacctgctcgcgaatgcgacggctgctctcggcctgaccgaacgtgatcgcttcgttgatcgcaacagccgatgcgcggtcgaccgtttccggtatgccgctcaccatcttgcgcacgtcgtcgagtccgttgatggtcaggccgatggtcatggagcggtctccgttactgcccacttgacgtagcgactgtcctcggaaggatgctccacgtcgagtttgaaagtcctgttgagctgcgggaaattaatccggttgccctcttctgcgacgatgccgtttgccagcagctcgcgagtgtcgatcacaacgtagtccacatcgtcgacggtcgtcgcgaagccttcgcggtcgaggtcgccgtacgtgcgcaccttgtagtgcaaacgagcggacgtgtccgtagacacgccgcccgccgaacggaacagggctgggataccgaacgtcttgtgcgtcacatcacgcgcgcgttgtttgatttcaagccagcccatgttccgtctcctagcgcccaggcgcgattactgctgcttcttgccgtcgttcttgtcggtcgtctcgaccttcggcggggcggagccagagctggccggagcctcgtcttcttccttcgccgcgtccttcgccgacttggcgtagccgttgtcgacgagctgcttctgcaacttggcgtcttcggtggtgaactcctggcccgcctggatttcctgcatcgcggtgcccaggccatccagggcatcgaagtcgcccttcagcgccacgcgagcgaccagcttcttgccagcggccgcagccttggtggtcttcttgtcgtcagccatttctacatctcctgttgcggggttgattgggtggtgtaaacagcgcggcccggcgaaccgggcgttgctggtgaaacggccttacgcgacgacgcgtgcgcgcagggtgcagttcggacggctcgggatcatgagcggcgcggactgcgacagcaggtagatcacggacgggtccgggttcttccacatcttcgggaagatgtcgagcgcctgcaaaccggcgtcggcatccatgatcgcgccgaaggcacgcacgccgtcgaagccaccttcagcttccagcagcacgtcgcgcgggtccatcatcggctgcatggtgccggtctcgtcttcgtacacatcgctgtacacgtagatgttgaacgcgccgatctggcccttgtactccacgctctcgcccaggcccgggccggtctcggcttccgacttcgagccgcgacgggtttccagcagctccttgatggccgggtgcttgcggaacgccttccaggcggtgctgcccatcgtgacgcgagtgaccacgaagccttcagcttcacggatacgcgcggcccaatcttccaggtcgtcgtccgggttgctgttgtcgtagtcgctccacgcggcggtgcccgacaggatgacggtgtggttggcggcacgaccgaagtcgatggtcacgctcgggtagtcttcgcccgacacggtgacctgaccgtacagcgcggcctgcgcgcccatccactcgaagcggcggtaaatctggttgcgctgatcgagctggtacgcggccacagtggcctgccagcgctggcccggggtcatgtcgccggtcagaccttcaccggccaagcgacgcagcatgcggcccggggtgaccgcatccttcggcttgacgtaggccggacggaaggtcttggtgtagaagccggaacgcttcaggacgcgaccctgcaagttcggagccacgaacggagccatgcgacggccgagacgcagctcgtcgaacatgatttcttcggtcgtgaagttgatctgctccttgtacagacggtcgaggaaatactgcacgggcggccggctgtcgacgatcaccttgcgcagttccgcagtgctatacaaatccatcgtgcttctcctgtttcagttgagttatgtgcgaaacgtattgcgggtgaatcgccggttagaccgggccggagttcggggcggggttgccgtacaggcgctgcgccacgatgttcgtgccgtcgaagaccgcgatcttcttctgcacggtgttggaggcagcgttgaaggtcagggcatcgacgttgaacacgccgcccgagtacgcaccttcccacttgccagcggtcggcgtcggaacgtcgtagccgaggatgtgggttgcgttctgcgaaccatcggtcgccgccggatcgtgcttggcgaacaggccggaggcggtgacgcggccgagcacctgaccgccgacgtaggcgacgccggtcacgagctgcacctgggtggtaacgatgtcggactcaccagcgaagagctggatgttgccattggcgttgctgttgtcgaccgagacgccagcgatggggccaaagttggtcattgcgatgtactcctgtgagtggactaggtagccggtttttcccgtctaggctggcgacggtgttctttacttgacggccttcagcacgctcttgttgccggtggcgtgggcgtaggcaccgagcagaccgccatcggccttctcgcccttgtcgccttcgtcttcgccgtcgccgccgttattggagatgtcagcgccgccgccggtcttttccatcgccgcgtcgagcgcggacttgccggtggaggccgacgccttcggcgacgcagcgagtgcggccttggcttcgtcgacgctcatgctgctcttgaaggcgaagtggttggcgagaccttcgcggcccttcgcttcttcgcaggtggtgatgccttcgatacgagcgcgctcgttggcagcgtggtcgaccttctcttcggtcttcttctgctgctcgacggtggcgtcggtcttcttctgctcttcgacggtggcgtcgggcttcttggtatcgctcatggtgggactcctgttttcgctggtggaagagccgaagacttcggcccggaaggaagcgactgcctcttgcggagacatgaccgcatcgaccaagccgaccttgaccgcatcgtccgcgccatagacgcgggcctgcgtgtcacgaatcgcttgttcggacattccgcgattagctgcaaccacggaaatgaacttctgccacatcccgtccaggcgcacctgcatgtcggcgcgcacgttgtcgggaagcggactataggggtttccgtcgaccttgtgttcgccggagtggatcagcgaaatggcgacgccgaacttctccatcgccttgctcagatcgacgtgcatggtgacgacgccgatgctgccggaatcgccggagggggtcgacaccatcttcttcgccgagctgcccagcgaatacgcgccagacatcgcgcccgcgttgacgaccgacagggtgggcttctcggcgcgcttgctgcggatgtgatcggccagctcgaagttgccgtagaccatgccgccgccggaatggatgtcgaatacgatgcccgccacgtccgggtcggccatcgcagcgtcgaactcgcgacgaatgtcgtcgtagccgcgcgtgccgtaccacgagtcgccgttacgatgcacgagcgtgccgcgcatcgggatgaaggcgaggccgtcgctgaaggcaaacgccttggaacgctcgcgcgggaacgagatgtcgaaggcacgctccatgagcaccacctgggcctcttcagccgccgcgcgctgttcggcggtcggcggggcctgctgaagcatcatcgacgagaacatcgtcgcgatattctccatctcctgcggtgcgatcagggccgggcggccgttgaagccctccatgatcgacatgcgcatcgccagcaattcattcatcgtcgttctccgtttcggtttcggtagccgtgtccgccttggcgtcatcgttcgcggcgctgtcagtagccttctgcgtgcccggcttgctggtcgacatcgtgaagttgagcttcttctgctcgatgaggcgctgctcgcgcatgtgctgctcgaacacttcgcgatagtccttgcccagcttgcccagctcgtcttcgtacgtcgacaggcccgatgcgatgcgcagcacggcggcctgggtttccttcagctcgtcgatctggccgcgcgatgcgccgatccagtcgcacttgatgtacgcctcgcgattgatgccctcgtagaaatgcgcggcacccttcggcatcggcagatcggtctccgggcggttgatttcctcttccagccacagcatgtagatcatcgtcgcgaagcggtcggtgatgagcttcttgcgcgactgcatgaacttccacgtctcgatcatagacgcacgagccgacgagtagttcgtcttcgagtagtccttcgagaactgctcgtagctcaggcccagcgccgcgcagatgtgccgcagcagcgagtcctcgaagtcactgccgacgccgcccggctgaccggcgttttgcaggttgagcttcgtgcccgggaacaaatgcgggatacgcacgccgtcgatagcgaggttgtcggaagaacccacgtactcggccagcgcgcccatgtacttctgcaaccacgtcatgtcgccggagccgagctgcgcgaacaccatctcgcgcggcagctccgactcgatagccgcagcaaaggtcgcattgaccaccgcgttttgcagaacgatgtccttgtagaccttcgtcatgcgcatttctttcagcaccgccaccatctgcgaaacaccacgcgtctgaccggggcgcaggatgtcggcgatgtggatgacctgcgggcggccccacggcttgaacgccggaacgcgcgtccacttcgcgccgaatcggtcgtagtaggattccatcgggtgagcgtcgcggatgtggtacgcctgggctgcaccgaaacgatcaatctccacgccacggcgcaggaacgcagtgtcgctattgtcgttcggattcgacaggcgatccgggtcgatcatgttgatggcggtcttgtacggacggccgttgcccttcaggtactccgaagtcgccagcgtctcgcccgccatgaacgcctgggccagcgccatgcgcacgagacccgtcaggccgttcttgcgcgaggcgtcaatccagttcatcggcgactcggcgtacagcatgaacttgcgctcggcgatgagctggaactcttcggcccacttttcgtcgaagccgagcgagcgccagtcgggccgagcgttcaaaaggtactggccgccgacgatggagtccttgctcgtgtcgagcgcgccctggatgtagccgtcgttgcgaatcagatcgcgggtgcgcgcatccatgcgcactttgtccggcgtgatttccatgtccggcggcagcgagggcgcggaccacaacgcggtctgtcggttgaggttcttcgcgccctcgaaggcaccgccgaaaatcatgtcgttcatcgtgcgctggaaggcggcatcgccctccggagaacgtactactgcgaggtcttggctcatggtctaggccgccttaaaagagagggcgaagggggccgccgattactgcgacccccagcatggcgttgatctgagcctggagcatggcgatgtacttcagcagggatgccgggttggcccggctgtactcaacccgctccccgttctggtcgaccacgaccgtcaccgcgccgcccatcatggcggtgtgataggccgcttgtgcctccgcaagcatggcttgcaactgttcgagggtcattgtgcgtcatcccagggtggctccgaattgaccgaaaccataatccgtagtcgggcttgacgcaaacctcttttcctgatcggcaggtcgcacaagagagttgttactccactcgtcgtaccagctctccgggttgtcccaatcgaaatgctcgaccttcagaatggtgcagaggccgaggcagtagtacgccaaatcccatgcttcgttgcgtcgcttgcctgggttcaaccaacggttcttgtcgtcgcggaactccaccgtcatctcgacgtacacatagtccggcgtccacttgttgaagaagtagcgagcaccgccgtccttcttcgcgtcgagcatgccgagcaacgtgtccttcagcacgttcgagttcaagaacagcaccggcacctcgccgcgcgcaccggccgagcgatcctttcgatccgagtcggggtagtcaatctcggcgcgcggggcaccgaacttcggctcgcccttgatgagcagcactcggttgcccttggcgctatcacgcattgaccgccagtagttgtaggcgcgcgtcgtggagcctgacttaccgccggagtcgatgcctgtcatcttgatcgacatgaagccgctgccgtcttccagctcgtactccttctcgacgacctgctctgtaatcaagtcccaatcttcctgcaccgcgtacggcttgacccacaacgtatcgcctgcgtcgtccttgcgcttcgacttctggatgttgaagcggtccaccatgtacacgtcgtagcccgcgccgctctcgctcgggccgatgccgtgtacggtcacgacgaacatgttcttctgaacgtcgacggtggcgagcaggaagcgagcgccgtacggcaccttcttctcggcccacttgatcgcgttcgattgcaggtcttccggcaggcggttcgagtcggtagcgttgaacggccagaacggttcgccctggtcggtgttgatcgtggccttcagcgccttcgtttcagcggtcagctcgaacgtctgctgggcctgcaacatacgctcgacgagcttctgccacgtgatgaagcgcgcggccggtcccttcagccagaacgacgcagtgcgcgaacgcgcgccgacgccctgcttgttgccgtcgcggtcgagactctgcccatcgcgaagccacacgccgcgtcggttcatctcgtacttgtgcttcggctcgatcacgcagccgttcttcgggcacgccatgacggtcgactcggaagccgcaaacggatcggggttcttcgtgtcccagcgcagcagcgagaacttcggctcgaaccactcgccgcagtgcgggcactgccagtagaagcagcggcggtcgccttcgttgtacaggccgccaatgccgtcagtcggcgggaacatgtgcgagtccgggcgcggcggcttccacttcgggtctttcacgtcgaacgacggcgacgactcggccagcgtcatgccgaacgagccgaacgtcgtggtgcgcttacgggccagcgggaacggcgggccgttcttctcgatgtcctgcggcatgcggtcgtagtcggtgagcgcaacacgcggcaccggcttgcccgagagctggttgatcgtcggccagcccagcgtgagcatcatgccgttgcggtagaacttgtcgaagatgttgtcgttgtcattgccgggacgcagcagtgcgccaatctcgcggctgtcgcggtgcatcttgtcgatacggcggtacgagaaatctcgcgccgtgtcgcgcgcggtctggatcaagaagaagtcggccgggtcgcagcgcgccgtgtacgcgatccagttcaagatgatttcggtcttgccgccctgcgcagggccgatgaagatgcacgactcaaaatcgcggctgttgagcacgtccatcggctcgacaaggtacggcgtctcttcattgagccaggggccgacgtacgatccttcgttgtcgaggtagcggtacttcgacgctgcctgcgatacggtcaaacgctcgggcgggagcagcaccgagttcgcagcgtaggtcagcagttcgcccaggtcgttgaaggtgctctgcgcgccctgggaaagctgtgcagacgaaaacaggtcatccatatcactcatcctcgtccagtccgatgtcgtcgaccttgatgtcggcgagctgctccttgtccttgaagcctgcgtacatctcgaagtcttccacaaggcgctggcgcagcgtcgtcaacgcgacatcggagatttcgcgctcgatgatcttgcgctgttccggcgtcaggtcggtgcgtgcctcaacgcgatccgccagcaggcgcaacgtctgcgacagcgagcggaaagcgccgacgaaaatctccatgacctgctgcgtgcgccacaggtcaccggcgttctccttgtacttcaacttgctgttctgcgcgttccaatactgcgcctgcaacgcggacggcaaatcgccagggccgacttccgcaaggtacttggcgatgtcgacgataggctccacgaggtacggcgcggcggccgacacgtggtaggtgggcgcgccacggcggtcgccggtcggacgcagcgggcgcaacttctcggtgacggtgcggcggtccaggcggaacaactgcgcgaggcgcgggatcgtcatgccgttgaagaactcttcttcgtagtcgattttagctgcggacatttttcagttctctctgtacgtcggcgacacgtcgccgcatgggttctttcagggcgtcttgcgttacttctttgcgcaccagctcgcgggtcaggtcttcttcaatcgtgcctatcgcggtcaggtgcatcatgttcacgtgtgaggcttgctggcctcggcggtgcaggcgctttcgcaactgcatgtacagctccaaatccggcgtgtggtcgtaccagatcaggttgttgccgccgcgctgaaggttgacgccgtgaccgatgctcgccggatgcacttctgcgatttcgatgtcacgcgcattccaggcgtcgatgtctttcttcgtcttcagcgagcggatgttcgggaacgcgtctttcagccggagccgcgagtgctgccacgtgcgcgccacgagaatcggcgagccgtcgctaaactcgacgatttccttcatgcgctcgatcttgcggtcatgcacgtcgatgaaggtcttctcatcatctccggtgtagacccggccgcatgcgaactgaagcagcttgccgtacaacgcgccttccgagagcgcgcggacgttcgggtcttcttcctctccccacttcagcaccgacgtgcgctcgaactcccgatactgctccaagaccttcttaggcaggatgatcggcaccgggcgaggaatgagcggcggcagcttgacgtaatcctcttcccgcagcgtgtacacgatgtcggcgacgcgcttggtgatcgacttcagcgcgaacggcttcggcgtgatcttgcgccccatgaactccttgttgaagaagtgcgcgaggaacttgctgtaggacgcgaacaaacgctcgccgccgtccatgatcgccatctgcgcccacacttgatgcaggccgttcggactaggcgtgccggtgagctggatcacgtcagtctcggggcggtgcgcgagctttaccgcgtgcttccagcgcttcgacgccttattgcggaacatgctcgattcgtcgaacacaatcgcgtcccacggcaccggcttcttgttgttcttgaacagcgacgcgagacgatccagcttatgcaccgagatgccgtcaatctcgcacggccgctccaactgcatgcgcatgtgctcaggcgtgccgtcgagttcctgaaagtcgagccagtgcgtgtgctcccagctatcgacctccgtaggccacgtgtcggacaccaccagcggcggcccgacgaccagcacgcggctccactcgccggagaacaccttgtcggacacgtgcgtgagcacgaccaccgtcttgcccaggcccatgtcgacccacaaagcacaactgccgacactctcgataaagaggccagcagcgcgttgatagtcgtccagtagcgagcgttcgagtcgttccttcatgcgaacacccactcggcgaactctttgtcgaagtagtcgatcaccagcacgaccatgcccttctttcgcagctccttgtgttcttcgatctggttcgccgtaggctttccgccggggcgcttgaactcgatgaagaacacgaagccgttgcggacgaacatgcggtcgggaacgctgctgttgccgggcgaagagaacttgtacgccttccacccggccttgcgcgccaccttgcaccacttctcttctacgtctttttcgagacggtgcttgtcggttgataggatgtcgcctctcatttctgatagcactccacggtttctgccttcgcgcggatcggcacttcgtcgccccaccactccggctgtacggtcatgtcgtcttcaaggtcgcgcgctgcaatctctgcgagcttcgccttgaccaagcctacgatttcatcgtgtacgtgcatgcggatgtccagcccgttgtcccaagcggtcacgatgccgatagccagcagctcgcgtgcaatcgcctgcaccaagttctcaacgatcttgccgccgtgcgagtcgatccgcatccagaccttgcggctcttcccgccgtagccctcgtagctgaagcccttcttcgacttgtacttcggcttgccggtcctcttgtcgatgccgaccttgatctttttccacgacatctgcggacgcaggtagtgcaggtagcggccggacggcaggcgcatgcgcaggaacggccccttcacgtccatgagaatcgggccgacgcgctgcggctccttcgtgcgcatcaccttctcgacagcacgttcgaggtcgtaccagagctgcacgatttcgtcgtactcgctgcggaagaacgctaccaccgcagccgcttcctccgccgtcatctcaatgcccatgctctctgcgtagcccagcaggccggtcttgatgacttccgggtactcgcccacttcgccgccgccggagagacggaaacctgcgccgagcacgccgggcttcgcctgctgccgcatccacttctcaaccttctcgtaggggacgccgaacatgcgcgaggcgaacaccttgtagatttcgaggttcttctgaaacacctcgatcatcttctgacaatccgccagccagccaatcgtgaccgactcgatagacgacagatcgcaggtgacgaacatcttgcccttcggtgccttgatcgcggtgcggatgcacgacgcgattgcgcccatcggcgacgacacgaggatgcggacccaatccatgtcctcggccatgatcgcttctcgcaaaagaaggagctgccactgctcttccatctctcggagggggcggggcaaattttgcacctgcaccgcgcggccagcccagcgtgcagtgcggcctgcgcctgcgaactgcatcgtgtagcacagcatgccgtcgacttcgatgtcgagcatcttctgcaacttggtgacagacgaacgcgcggcctcggagtgcagcgcgagcacttcgttcgcttcgtcggtcatgttccaatcccaatcctcgcgagccttgcggatcgaggcggatttgagattggtgaacggatagccgcgctcgcgcagccagggtaggagctgcgtgccgctagtcgggttttcgaggcccgtgatgcgcttcatgatcttcgtgaggcgcgccttctccttcgagatgacgcgcagcgccgcttcgacgtatgccttgtcgaacggcacgccacgctcgttgatgtgctggtcgatagtccacaagcgctgctcgaacgcgctcatcgggaagcgggccatcttgcgtgcagcagcgcgctcggcgatcacgtcgcggcggccatagtcgaggaacttctgccacttcaccggatcggtgagcttggtgttgcgggtgtactgcttggtcttggtcggcttacgtggctggcagaagaacttcaccagcgccttgccctccttcatcttcgccgtcttgtcgtccaggcgcagcacggtggagagcgtatcgaggtcgccgggcagcgccagcgagaatgcgtgtgccatcgagcactcgaactgctcgacgggaatatcgatgtccagcacgtgcagccagatggcgcgctcgaactgcgcgttgtgcgcggccttcttgacacgtgggttcttcaacgcaaggcgcaggcgcttcggcatcatctgcgtcttcgggaaccatacctgcggctcttcgtcgtcgaacgcgtaccacaggaacagcacttcggtcgacctgtgcgtggcgtagcgtttgagaccgtgctttttcaggtcgcattcgctgaaggtctcgaagtcgtggtgcagcgtcgagtcgtattgaggcttttgcatgcgctggtctcagaaaaacggaagcccggggacaagccccgggcgaccgaagtagcactgtcaacccgaggaattacaggccgatgtcgtcgtcatcgtcttcgtcctcgtcgcgcgaacggcggcgggagttcgacggcttcttcgacgaggaacggcgcggacgctcttcctcttcttcctcttcatcctcttcgtcctcgtcacgagaacgacggctcgacttcgacggcttcttggaggaacggcgcgcggggcgttcgtcctcttcgtcctcgtcgacatccacgtcgtcgaaatcgtcgtccagctcgtcgagcacgtcgtccacgtcgggacgcattgcgccgccgagcggatcatcgtgcatcacgtgctggatgatgtcgaagccgcagttgatgcgcttgccgtacttgttcttcttcttcatcgacttgccgttctgcgcccaggggcgaatcacagcgttgacccacgcgccggaatagatcatttcatcttcttccatcaccggctgacggtcgcggtcgaccagcgtcgggcggcggctctcgcgaacgttgacgacccaatggccctcgtgctctgcgatgtcaccgtcgtcgccgtcgtgcaggaagcgcttgtcgctgcccaccttgccgccgtcgtactcttcggcgatgaggtcggcgatcaccttgtccaacttcttcttggtgcgtgcgccggtcgccttcgggatcagcaacgcggtgcggtaggacttggttttcttgccttcatcgttttcctgctcatcggggttgtgcaggtaggcgaacgaaaggcgagcgcctttcagaaggtagcgaccatcgcccttgtccacgaggtcgttctgcgggatttgcttcttagccacggtgttgctcctatcgttgtcgagactatcgtctgtcgagattgtcggttgtcgggattgtcgaactactacgtgcgtcagtcatcaaggagcgacaacttctgcacggtcaggtcttgccgcttgtcgtctgcggagaccagacacggtttgccgggcttcgatgcgatgaagtcctgcaatttcttcttcgcctcgccgcgcagcaacttctctgcggcgtggggcgaaataaactcgggcttagagtacagcttttcgggcttgatgccagcatcgaccatgagcatttcagcatcgagttcgctggtgaagtagcgcgacttcttgcctgcaaccaccttcaggccgggcacaaactcgtcgttggcgatcttggtgtgcaggtagtcggcgatagcgcccatgcgcttgtcgtacatgctcttacgcagccacaccgccgacagctcttcgaggctcatcatcgtgaggtcgtcttcaacgaagtccccgtcatcgtccagcagcatgacgcgctggtggtagaggaagtcgtggttggcgcggcacttgtactgcaccttgcagaaccggcacgccttctcgctcgggccgaacggcgggttcttgctgagcgccagggcgaagcgcttcttgatcttctcgccgatagccagcagctcggccttgctcgtgacccacgtgctgaagttctcgacgcgcggctgcgcaatgcggatgaccacttcgtcgaagtcgtacagccagtcccactcgttgatgaagccgagcgcgtacatgatgagctggaagttgttctccggctcgacgaagatacggccgtacttgaagtcggtgacgaccagcttcttgtacatggccgctgcgtggtcgcacgtgccgaactgatcggggatcgggcaccaccgcgagatgttcactcgctgctcaacgaagtggcaccccggcagacgcatcacgtaatcgagatactgaccgacgccagcaaccatctcgtcgtcaacagtgatagcgaagcctttcgaggaatgaagctcttcgtcgtagtcggcatcaaggttgccgctatcgaacaccattcctagaaactcttccgggtctttgccggtcaacaggcaggtctcgccgatgtgatgcgcaacggtgccttcggccgcctcgtagttctcgctgtccggctcctgctcgttgagcaccaagctggccgggcagtcgaagatgcgctgtgcagacgacggcgcaaagcgcgcatgcgcacgcactgcttccttgacggcctttgcgagtttgttgcgacgtggcttcatcgtgtcctctcgaaagaacgcccggcatcgccgggcgtccgtgttacgtgcaggccgaattacttcttgcggctggccgcgcgcttgatttccttcatcgcttccgggtacttcttggccggaatgttcaggacgttgctctcgtcgagcagggccagcaccttcttgcaggcgtcgacgccgtggctggacttcagcgccttgaaggaggcgaccagctcttcctgggtcacttcttcttcgtcgtcttccaggccgaggtcgtcgtcgccttcgtcctcgtcgccgtcaccttcttcttcgtcttcgtcgtccagcgggtcgggcttcgacttgcccttgcccttcggagcggccttctcggccggtgccttcttggtgctgcccgccgggcggccgcgaccgcgcttcggcgcttcttcttcgtcaccaccgtcttcggattcgttgacggagctgttgctgctggtcccgcccacggcttcgatgatgagaacgatggcggcggcgagcttcttcgcgttgatggtggacatcggtttgttgctcctagctaggttggttttgggagtgacgggcggattgcaattcctgcccggcgagcgcactatgcgcccgtcccaacgctaagtcaataggcacgcaaagcggcttagcagaccccttgaaacccacacgccgcgaggattccatgcgccgagacctaacccttgattcactggacagcgccgacgcgcgcgtccgctatctactccggcgcatcgccctaatgctcgacccgccgtacggtcggctcaacgcaatctgcgagaagtacaactggcacgagaccaccgtgtcgcgttggcaacgtctcggatgcgtgccgcgcgacaaggcttcgatcttgcacaaagacttcaaccgtgagattggattcaatctcgaagacctcgttggcgacgacatcgcggagtgacgcacatggctggacgaccgatcaccagcgtgcttcgcaaatacggcgcgcagttgctcgaaaacggctactccatcatcccgattccgaagggacggaaaggcccaatcgagccgaagtggcagcatattgaagcaacgccgaagctggtaaagaagtgggcgagcggcgactacacgcagggcaacatcggcttcttgacgaagcacacgcctgccgtggacatcgacatctacgacgccgagatggccgagttgatggccgagcacgcgcttgaaatctgcggcaagacgatgacgcgtgtcggcatggccccgaagaccatgctcgtgtaccgcaccgacatcccgttccagaagcgcaagatcaccttcgtcgacgaagaaggtaccgagcacgcaatcgaagtcctgggcgacggccagcagtttgttggcatcggcctgcacccggagacgaagaagccgtaccgctggacttccggcaagggcatgaacccggtgagcgtgccgcacgacatgctgccggaaatcacgaccgacgccatcgacgagttgttctcggtcttcaagctcgaagcgcagcgtcgcggctggacgttgaagaagcacaacgcaccgcgcgatgcgagtcgcgacgacatcgacgacgagaacgaccgcgcactgctggcgcacaagcagccgctcgaaaacctgaccgccgatcagctccgcgaggtgctgcaatgggtgccgggtgctgacgactacgagcagtggttgaaggtcggcatggcgctgcaccatcaattcgacggcgaggaagagggcctgtcgctctggcacgagtggtccgaaacgtcgagcgaatacgacgccgactcgctggaagaaaagtggaacacgttccacgatgagatgggccggaacatcaccacggccgcatcgctcatcaagatcgcgaaggagcaccggcaggaggtcgccgaggaacagttcgagaagatcaagcgcaaggtacatgagaccgaaagcgcgatggaacttcttggcccgctggcgaagaagtggggccggttgatggagcacgactatcaggccgagctgctggtgggcgaaatccagaagcgcgtcaaggagctgaccggcaagtcgccgagcatcgcgaccgtacgcaaggcggtgaacgagggctaccgcaattccgacttcaactacaaggagctgccgttctggtgcaacgacgtggtgtacgtcgacaccgaggaagagttcttcttgatggagaaccgcgtcgcgctgagcgagcgtgcgttcaacgcgcgcaacaaccgccacctgctgtcgaagaaggatcgctcgaacatggacgcggtgccggagcagcaggcatcggccctggcgctcaacgtgtatcaggttccggtcgtgagcggctacgtgtacctgcccggtgccgagcgaatcgttgaatggaatgaccagaagcacgtcaacctgttcaacccggaagacatcgtgccgatccccgagaagatgggcggcaaggcgcggcgtgcggtcgaggcggtgaagcgtcacttcgagatttcctacccgatccagcgcgagcgcgagctgctgctgtcctggctggcgttcactatcaagcgcatggacaagaagattcgctgggccgtggtgatgcagggtatcgacggtgccggtaagggtttcgtcggcgaaatgctcatggcgatcctgtcgaagaacaacgtcatcaccgtcaacgcgcaacgcctggaagagaagtacaccgagttctacgagcgcaacaaggtcgtcgtgttcgaggaagcccgcatcgccggtacgtcgcgctacgccgtgatggacaagctgaagccctacatcacgaacgacgtggtggacatccgcaagatgcacagcggcggcttcaacgtgccgaacgtcagctccacgatcatcctgaccaatcacagcgacgcgctgccggtgtacgacgccgaccgccggtacttcgtggtctcgactcacttccagacgaagcagatgatcgagaagttccgcgcgcagcaccccgaccactacgacgacatcttcaacgccatcgcctatcacgcgggcgcgctgcgcgagtggctggaagactacccgctgcatcccgagttcgacccggacggccacgcgccgatgacggacgccaaggaacgcatgatcgacctggctcgcggcgacgacgaagacgagctgctggaaatcatcaacgagagcaccgacccggaagtcaacaacatgctgctcaacgtcggcaggctgcgcgacgcggcgctggatgcgtcgtgcggagttccgttcgggccgaagctgtcgaacttcctgaccgccaagggcttcgtctacgttggccgggcgcgcggtgcgagcggcaagctggcgcgctattggtcgaagcatcccgagctggtgatgaagccgaacctgcaagcctggatcaccgacttcatcgaactcgcacgcatcaagatgtaacctacaaccgcccaatccagggcacaggagaaacgcaatgaccaccaccgtcaaactctcgtacgtccacggtaacaaggcgctcgccgtcaagctcgaaggcaacagcgtcggcgaactcggcccgggccgcagcatcgaagtgagcctgcactcgggccagcagctcaccatcgacgagaccggagagttcttcggcagcaccaagtcggaagtgcagcagccccaggccaccgtagacgaagccacgaccgacgccgctgcgtacgaaggccgccgcgatctgccgccgggcgctggcgaacccggctcgaacgtgccggacacccgcgtcgaataaacgcacaccggcagcgaggcaaaaagaaacccccgggtcgccccgggggtttttcgttgcgccgaattagccgactcgatcctgccatgccgggtccggcttggcctcaatgcgcaatttccacccgaaccacatcgcggcaatttccggccgccggtacgcgcctttctttttccgttccagcagggtcgccttgtcggccactccttttttcagcagcagggtgcggctgatctgcgacacgaaatatttcttgtagacggcttcctcgaagtcagcgcgcgtgctctcaatttcgtcggtttcagcgatcatcggcatttctcggtgtgccggacgaatttccggcgaattaattatcggcaattctttccaatcgcgcaaggtactgtcacaagcccgggaattaactccttgtgacactgacgaattaatttgggccgatgtggcgaaaaaagcgtcactgtcacaaggtactgtcacaagccgaaacccttgtcctgcctacttttcctcttattttgtgacagtagtgacagtagtgacagtaccttctgctacacgcaggaatacgaattgtccctcaaatattagcaatggtactaatttgtggccgtttttcgtgttttctttcccggtaagggagaaggtttcagtgtcacagtgtcacaaaggcccaactcgcagtagcaaatcgacctcaaaacccttccaaatcaaccgtttgcgcggggggccgagttgtgacagtaccgcaaatcgtcagtgtcactactgtcacaagcgaataaattaattcctagcccggaaatgcggtgcagcgcgcggttcggccccttataggagacggaaatgcgaaaaaattgaaaaatgcgcgagcaccggggtcagcgccccc

SEQ ID NO: 14 - DNA, 56144 bp, Unknown
  Bacteriophage Xfas104
gggggcgctgaccccggtgctcgcgcatttttcaattttttcgcatttccgtctcctataaggggccgaaccgcgcgctgcaccgcatttccgggctaggaattaatttattcgcttgtgacagtagtgacactgacgatttgcggtactgtcacaactcggccccccgcgcaaacggttgatttggaagggttttgaggtcgatttgctactgcgagttgggcctttgtgacactgtgacactgaaaccttctcccttaccgggaaagaaaacacgaaaaacggccacaaattagtaccattgctaatatttgagggacaattcgtattcctgcgtgtagcagaaggtactgtcactactgtcactactgtcacaaaataagaggaaaagtaggcaggacaagggtttcggcttgtgacagtaccttgtgacagtgacgcttttttcgccacatcggcccaaattaattcgtcagtgtcacaaggagttaattcccgggcttgtgacagtaccttgcgcgattggaaagaattgccgataattaattcgccggaaattcgtccggcacaccgagaaatgccgatgatcgctgaaaccgacgaaattgagagcacgcgcgctgacttcgaggaagccgtctacaagaaatatttcgtgtcgcagatcagccgcaccctgctgctgaaaaaaggagtggccgacaaggcgaccctgctggaacggaaaaagaaaggcgcgtaccggcggccggaaattgccgcgatgtggttcgggtggaaattgcgcattgaggccaagccggacccggcatggcaggatcgagtcggctaattcggcgcaacgaaaaacccccggggcgacccgggggtttctttttgcctcgctgccggtgtgcgtttattcgacgcgggtgtccggcacgttcgagccgggttcgccagcgcccggcggcagatcgcggcggccttcgtacgcagcggcgtcggtcgtggcttcgtctacggtggcctggggctgctgcacttccgacttggtgctgccgaagaactctccggtctcgtcgatggtgagctgctggcccgagtgcaggctcacttcgatgctgcggcccgggccgagttcgccgacgctgttgccttcgagcttgacggcgagcgccttgttaccgtggacgtacgagagtttgacggtggtggtcattgcgtttctcctgtgccctggattgggcggttgtaggttacatcttgatgcgtgcgagttcgatgaagtcggtgatccaggcttgcaggttcggcttcatcaccagctcgggatgcttcgaccaatagcgcgccagcttgccgctcgcaccgcgcgcccggccaacgtagacgaagcccttggcggtcaggaagttcgacagcttcggcccgaacggaactccgcacgacgcatccagcgccgcgtcgcgcagcctgccgacgttgagcagcatgttgttgacttccgggtcggtgctctcgttgatgatttccagcagctcgtcttcgtcgtcgccgcgagccaggtcgatcatgcgttccttggcgtccgtcatcggcgcgtggccgtccgggtcgaactcgggatgcagcgggtagtcttccagccactcgcgcagcgcgcccgcgtgataggcgatggcgttgaagatgtcgtcgtagtggtcggggtgctgcgcgcggaacttctcgatcatctgcttcgtctggaagtgagtcgagaccacgaagtaccggcggtcggcgtcgtacaccggcagcgcgtcgctgtgattggtcaggatgatcgtggagctgacgttcggcacgttgaagccgccgctgtgcatcttgcggatgtccaccacgtcgttcgtgatgtagggcttcagcttgtccatcacggcgtagcgcgacgtaccggcgatgcgggcttcctcgaacacgacgaccttgttgcgctcgtagaactcggtgtacttctcttccaggcgttgcgcgttgacggtgatgacgttgttcttcgacaggatcgccatgagcatttcgccgacgaaacccttaccggcaccgtcgataccctgcatcaccacggcccagcgaatcttcttgtccatgcgcttgatagtgaacgccagccaggacagcagcagctcgcgctcgcgctggatcgggtaggaaatctcgaagtgacgcttcaccgcctcgaccgcacgccgcgccttgccgcccatcttctcggggatcggcacgatgtcttccgggttgaacaggttgacgtgcttctggtcattccattcaacgattcgctcggcaccgggcaggtacacgtagccgctcacgaccggaacctgatacacgttgagcgccagggccgatgcctgctgctccggcaccgcgtccatgttcgagcgatccttcttcgacagcaggtggcggttgttgcgcgcgttgaacgcacgctcgctcagcgcgacgcggttctccatcaagaagaactcttcctcggtgtcgacgtacaccacgtcgttgcaccagaacggcagctccttgtagttgaagtcggaattgcggtagccctcgttcaccgccttgcgtacggtcgcgatgctcggcgacttgccggtcagctccttgacgcgcttctggatttcgcccaccagcagctcggcctgatagtcgtgctccatcaaccggccccacttcttcgccagcgggccaagaagttccatcgcgctttcggtctcatgtaccttgcgcttgatcttctcgaactgttcctcggcgacctcctgccggtgctccttcgcgatcttgatgagcgatgcggccgtggtgatgttccggcccatctcatcgtggaacgtgttccacttttcttccagcgagtcggcgtcgtattcgctcgacgtttcggaccactcgtgccagagcgacaggccctcttcctcgccgtcgaattgatggtgcagcgccatgccgaccttcaaccactgctcgtagtcgtcagcacccggcacccattgcagcacctcgcggagctgatcggcggtcaggttttcgagcggctgcttgtgcgccagcagtgcgcggtcgttctcgtcgtcgatgtcgtcgcgactcgcatcgcgcggtgcgttgtgcttcttcaacgtccagccgcgacgctgcgcttcgagcttgaagaccgagaacaactcgtcgatggcgtcggtcgtgatttccggcagcatgtcgtgcggcacgctcaccgggttcatgcccttgccggaagtccagcggtacggcttcttcgtctccgggtgcaggccgatgccaacaaactgctggccgtcgcccaggacttcgattgcgtgctcggtaccttcttcgtcgacgaaggtgatcttgcgcttctggaacgggatgtcggtgcggtacacgagcatggtcttcggggccatgccgacacgcgtcatcgtcttgccgcagatttcaagcgcgtgctcggccatcaactcggccatctcggcgtcgtagatgtcgatgtccacggcaggcgtgtgcttcgtcaagaagccgatgttgccctgcgtgtagtcgccgctcgcccacttctttaccagcttcggcgttgcttcaatatgctgccacttcggctcgattgggcctttccgtcccttcggaatcgggatgatggagtagccgttttcgagcaactgcgcgccgtatttgcgaagcacgctggtgatcggtcgtccagccatgtgcgtcactccgcgatgtcgtcgccaacgaggtcttcgagattgaatccaatctcacggttgaagtctttgtgcaagatcgaagccttgtcgcgcggcacgcatccgagacgttgccaacgcgacacggtggtctcgtgccagttgtacttctcgcagattgcgttgagccgaccgtacggcgggtcgagcattagggcgatgcgccggagtagatagcggacgcgcgcgtcggcgctgtccagtgaatcaagggttaggtctcggcgcatggaatcctcgcggcgtgtgggtttcaaggggtctgctaagccgctttgcgtgcctattgacttagcgttgggacgggcgcatagtgcgctcgccgggcaggaattgcaatccgcccgtcactcccaaaaccaacctagctaggagcaacaaaccgatgtccaccatcaacgcgaagaagctcgccgccgccatcgttctcatcatcgaagccgtgggcgggaccagcagcaacagctccgtcaacgaatccgaagacggtggtgacgaagaagaagcgccgaagcgcggtcgcggccgcccggcgggcagcaccaagaaggcaccggccgagaaggccgctccgaagggcaagggcaagtcgaagcccgacccgctggacgacgaagacgaagaagaaggtgacggcgacgaggacgaaggcgacgacgacctcggcctggaagacgacgaagaagaagtgacccaggaagagctggtcgcctccttcaaggcgctgaagtccagccacggcgtcgacgcctgcaagaaggtgctggccctgctcgacgagagcaacgtcctgaacattccggccaagaagtacccggaagcgatgaaggaaatcaagcgcgcggccagccgcaagaagtaattcggcctgcacgtaacacggacgcccggcgatgccgggcgttctttcgagaggacacgatgaagccacgtcgcaacaaactcgcaaaggccgtcaaggaagcagtgcgtgcgcatgcgcgctttgcgccgtcgtctgcacagcgcatcttcgactgcccggccagcttggtgctcaacgagcaggagccggacagcgagaactacgaggcggccgaaggcaccgttgcgcatcacatcggcgagacctgcctgttgaccggcaaagacccggaagagtttctaggaatggtgttcgatagcggcaaccttgatgccgactacgacgaagagcttcattcctcgaaaggcttcgctatcactgttgacgacgagatggttgctggcgtcggtcagtatctcgattacgtgatgcgtctgccggggtgccacttcgttgagcagcgagtgaacatctcgcggtggtgcccgatccccgatcagttcggcacgtgcgaccacgcagcggccatgtacaagaagctggtcgtcaccgacttcaagtacggccgtatcttcgtcgagccggagaacaacttccagctcatcatgtacgcgctcggcttcatcaacgagtgggactggctgtacgacttcgacgaagtggtcatccgcattgcgcagccgcgcgtcgagaacttcagcacgtgggtcacgagcaaggccgagctgctggctatcggcgagaagatcaagaagcgcttcgccctggcgctcagcaagaacccgccgttcggcccgagcgagaaggcgtgccggttctgcaaggtgcagtacaagtgccgcgccaaccacgacttcctctaccaccagcgcgtcatgctgctggacgatgacggggacttcgttgaagacgacctcacgatgatgagcctcgaagagctgtcggcggtgtggctgcgtaagagcatgtacgacaagcgcatgggcgctatcgccgactacctgcacaccaagatcgccaacgacgagtttgtgcccggcctgaaggtggttgcaggcaagaagtcgcgctacttcaccagcgaactcgatgctgaaatgctcatggtcgatgctggcatcaagcccgaaaagctgtactctaagcccgagtttatttcgccccacgccgcagagaagttgctgcgcggcgaggcgaagaagaaattgcaggacttcatcgcatcgaagcccggcaaaccgtgtctggtctccgcagacgacaagcggcaagacctgaccgtgcagaagttgtcgctccttgatgactgacgcacgtagtagttcgacaatcccgacaaccgacaatctcgacagacgatagtctcgacaacgataggagcaacaccgtggctaagaagcaaatcccgcagaacgacctcgtggacaagggcgatggtcgctaccttctgaaaggcgctcgcctttcgttcgcctacctgcacaaccccgatgagcaggaaaacgatgaaggcaagaaaaccaagtcctaccgcaccgcgttgctgatcccgaaggcgaccggcgcacgcaccaagaagaagttggacaaggtgatcgccgacctcatcgccgaagagtacgacggcggcaaggtgggcagcgacaagcgcttcctgcacgacggcgacgacggtgacatcgcagagcacgagggccattgggtcgtcaacgttcgcgagagccgccgcccgacgctggtcgaccgcgaccgtcagccggtgatggaagaagatgaaatgatctattccggcgcgtgggtcaacgctgtgattcgcccctgggcgcagaacggcaagtcgatgaagaagaagaacaagtacggcaagcgcatcaactgcggcttcgacatcatccagcacgtgatgcacgatgatccgctcggcggcgcaatgcgtcccgacgtggacgacgtgctcgacgagctggacgacgatttcgacgacgtggatgtcgacgaggacgaagaggacgaacgccccgcgcgccgttcctccaagaagccgtcgaagtcgagccgtcgttctcgtgacgaggacgaagaggatgaagaggaagaagaggaagagcgtccgcgccgttcctcgtcgaagaagccgtcgaactcccgccgccgttcgcgcgacgaggacgaagacgatgacgacgacatcggcctgtaattcctcgggttgacagtgctacttcggtcgcccggggcttgtccccgggcttccgtttttctgagaccagcgcatgcaaaagcctcaatacgactcgacgctgcaccacgacttcgagaccttcagcgaatgcgacctgaaaaagcacggtctcaaacgctacgccacgcacaggtcgaccgaagtgctgttcctgtggtacgcgttcgacgacgaagagccgcaggtatggttcccgaagacgcagatgatgccgaagcgcctgcgccttgcgttgaagaacccacgtgtcaagaaggccgcgcacaacgcgcagttcgagcgcgccatctggctgcacgtgctggacatcgatattcccgtcgagcagttcgagtgctcgatggcacacgcattctcgctggcgctgcccggcgacctcgatacgctctccaccgtgctgcgcctggacgacaagacggcgaagatgaaggagggcaaggcgctggtgaagttcttctgccagccacgtaagccgaccaagaccaagcagtacacccgcaacaccaagctcaccgatccggtgaagtggcagaagttcctcgactatggccgccgcgacgtgatcgccgagcgcgctgctgcacgcaagatggcccgcttcccgatgagcgcgttcgagcagcgcttgtggactatcgaccagcacatcaacgagcgtggcgtgccgttcgacaaggcatacgtcgaagcggcgctgcgcgtcatctcgaaggagaaggcgcgcctcacgaagatcatgaagcgcatcacgggcctcgaaaacccgactagcggcacgcagctcctaccctggctgcgcgagcgcggctatccgttcaccaatctcaaatccgcctcgatccgcaaggctcgcgaggattgggattggaacatgaccgacgaagcgaacgaagtgctcgcgctgcactccgaggccgcgcgttcgtctgtcaccaagttgcagaagatgctcgacatcgaagtcgacggcatgctgtgctacacgatgcagttcgcaggcgcaggccgcactgcacgctgggctggccgcgcggtgcaggtgcaaaatttgccccgccccctccgagagatggaagagcagtggcagctccttcttttgcgagaagcgatcatggccgaggacatggattgggtccgcatcctcgtgtcgtcgccgatgggcgcaatcgcgtcgtgcatccgcaccgcgatcaaggcaccgaagggcaagatgttcgtcacctgcgatctgtcgtctatcgagtcggtcacgattggctggctggcggattgtcagaagatgatcgaggtgtttcagaagaacctcgaaatctacaaggtgttcgcctcgcgcatgttcggcgtcccctacgagaaggttgagaagtggatgcggcagcaggcgaagcccggcgtgctcggcgcaggtttccgtctctccggcggcggcgaagtgggcgagtacccggaagtcatcaagaccggcctgctgggctacgcagagagcatgggcattgagatgacggcggaggaagcggctgcggtggtagcgttcttccgcagcgagtacgacgaaatcgtgcagctctggtacgacctcgaacgtgctgtcgagaaggtgatgcgcacgaaggagccgcagcgcgtcggcccgattctcatggacgtgaaggggccgttcctgcgcatgcgcctgccgtccggccgctacctgcactacctgcgtccgcagatgtcgtggaaaaagatcaaggtcggcatcgacaagaggaccggcaagccgaagtacaagtcgaagaagggcttcagctacgagggctacggcgggaagagccgcaaggtctggatgcggatcgactcgcacggcggcaagatcgttgagaacttggtgcaggcgattgcacgcgagctgctggctatcggcatcgtgaccgcttgggacaacgggctggacatccgcatgcacgtacacgatgaaatcgtaggcttggtcaaggcgaagctcgcagagattgcagcgcgcgaccttgaagacgacatgaccgtacagccggagtggtggggcgacgaagtgccgatccgcgcgaaggcagaaaccgtggagtgctatcagaaatgagaggcgacatcctatcaaccgacaagcaccgtctcgaaaaagacgtagaagagaagtggtgcaaggtggcgcgcaaggccgggtggaaggcgtacaagttctcttcgcccggcaacagcagcgttcccgaccgcatgttcgtccgcaacggcttcgtgttcttcatcgagttcaagcgccccggcggaaagcctacggcgaaccagatcgaagaacacaaggagctgcgaaagaagggcatggtcgtgctggtgatcgactacttcgacaaagagttcgccgagtgggtgttcgcatgaaggaacgactcgaacgctcgctactggacgactatcaacgcgctgctggcctctttatcgagagtgtcggcagttgtgctttgtgggtcgacatgggcctgggcaagacggtggtcgtgctcacgcacgtgtccgacaaggtgttctccggcgagtggagccgcgtgctggtcgtcgggccgccgctggtggtgtccgacacgtggcctacggaggtcgatagctgggagcacacgcactggctcgactttcaggaactcgacggcacgcctgagcacatgcgcatgcagttggagcggccgtgcgagattgacggcatctcggtgcataagctggatcgtctcgcgtcgctgttcaagaacaacaagaagccggtgccgtgggacgcgattgtgttcgacgaatcgagcatgttccgcaataaggcgtcgaagcgctggaagcacgcggtaaagctcgcgcaccgccccgagactgacgtgatccagctcaccggcacgcctagtccgaacggcctgcatcaagtgtgggcgcagatggcgatcatggacggcggcgagcgtttgttcgcgtcctacagcaagttcctcgcgcacttcttcaacaaggagttcatggggcgcaagatcacgccgaagccgttcgcgctgaagtcgatcaccaagcgcgtcgccgacatcgtgtacacgctgcgggaagaggattacgtcaagctgccgccgctcattcctcgcccggtgccgatcatcctgcctaagaaggtcttggagcagtatcgggagttcgagcgcacgtcggtgctgaagtggggagaggaagaagacccgaacgtccgcgcgctctcggaaggcgcgttgtacggcaagctgcttcagttcgcatgcggccgggtctacaccggagatgatgagaagaccttcatcgacgtgcatgaccgcaagatcgagcgcatgaaggaaatcgtcgagtttagcgacggctcgccgattctcgtggcgcgcacgtggcagcactcgcggctccggctgaaagacgcgttcccgaacatccgctcgctgaagacgaagaaagacatcgacgcctggaatgcgcgtgacatcgaaatcgcagaagtgcatccggcgagcatcggtcacggcgtcaaccttcagcgcggcggcaacaacctgatctggtacgaccacacgccggatttggagctgtacatgcagttgcgaaagcgcctgcaccgccgaggccagcaagcctcacacgtgaacatgatgcacctgaccgcgataggcacgattgaagaagacctgacccgcgagctggtgcgcaaagaagtaacgcaagacgccctgaaagaacccatgcggcgacgtgtcgccgacgtacagagagaactgaaaaatgtccgcagctaaaatcgactacgaagaagagttcttcaacggcatgacgatcccgcgcctcgcgcagttgttccgcctggaccgccgcaccgtcaccgagaagttgcgcccgctgcgtccgaccggcgaccgccgtggcgcgcccacctaccacgtgtcggccgccgcgccgtacctcgtggagcctatcgtcgacatcgccaagtaccttgcggaagtcggccctggcgatttgccgtccgcgttgcaggcgcagtattggaacgcgcagaacagcaagttgaagtacaaggagaacgccggtgacctgtggcgcacgcagcaggtcatggagattttcgtcggcgctttccgctcgctgtcgcagacgttgcgcctgctggcggatcgcgttgaggcacgcaccgacctgacgccggaacagcgcaagatcatcgagcgcgaaatctccgatgtcgcgttgacgacgctgcgccagcgccttgtggaagacttcgagatgtacgcaggcttcaaggacaaggagcagctcgccgacatcaaggtcgacgacatcggactggacgaggatgagtgatatggatgacctgttttcgtctgcacagctttcccagggcgcgcagagcaccttcaacgacctgggcgaactgctgacctacgctgcgaactcggtgctgctcccgcccgagcgtttgaccgtatcgcaggcagcgtcgaagtaccgctacctcgacaacgaaggatcgtacgtcggcccctggctcaatgaagagacgccgtaccttgtcgagccgatggacgtgctcaacagccgcgattttgagtcgtgcatcttcatcggccctgcgcagggcggcaagaccgaaatcatcttgaactggatcgcgtacacggcgcgctgcgacccggccgacttcttcttgatccagaccgcgcgcgacacggcgcgagatttctcgtaccgccgtatcgacaagatgcaccgcgacagccgcgagattggcgcactgctgcgtcccggcaatgacaacgacaacatcttcgacaagttctaccgcaacggcatgatgctcacgctgggctggccgacgatcaaccagctctcgggcaagccggtgccgcgtgttgcgctcaccgactacgaccgcatgccgcaggacatcgagaagaacggcccgccgttcccgctggcccgtaagcgcaccacgacgttcggctcgttcggcatgacgctggccgagtcgtcgccgtcgttcgacgtgaaagacccgaagtggaagccgccgcgcccggactcgcacatgttcccgccgactgacggcattggcggcctgtacaacgaaggcgaccgccgctgcttctactggcagtgcccgcactgcggcgagtggttcgagccgaagttctcgctgctgcgctgggacacgaagaaccccgatccgtttgcggcttccgagtcgaccgtcatggcgtgcccgaagaacggctgcgtgatcgagccgaagcacaagtacgagatgaaccgacgcggcgtgtggcttcgcgatgggcagagtctcgaccgcgacggcaacaagcagggcgtcggcgcgcgttcgcgcactgcgtcgttctggctgaagggaccggccgcgcgcttcatcacgtggcagaagctcgtcgagcgtatgttgcaggcccagcagacgttcgagctgaccgctgaaacgaaggcgctgaaggccacgatcaacaccgaccagggcgaaccgttctggccgttcaacgctaccgactcgaaccgcctgccggaagacctgcaatcgaacgcgatcaagtgggccgagaagaaggtgccgtacggcgctcgcttcctgctcgccaccgtcgacgttcagaagaacatgttcgtcgtgaccgtacacggcatcggcccgagcgagagcggcgcgggctacgacgtgtacatggtggaccgcttcaacatccagaagtcgaagcgcaaggacgacgcaggcgatacgttgtgggtcaagccgtacgcggtgcaggaagattgggacttgattacagagcaggtcgtcgagaaggagtacgagctggaagacggcagcggcttcatgtcgatcaagatgacaggcatcgactccggcggtaagtcaggctccacgacgcgcgcctacaactactggcggtcaatgcgtgatagcgccaagggcaaccgagtgctgctcatcaagggcgagccgaagttcggtgccccgcgcgccgagattgactaccccgactcggatcgaaaggatcgctcggccggtgcgcgcggcgaggtgccggtgctgttcttgaactcgaacgtgctgaaggacacgttgctcggcatgctcgacgcgaagaaggacggcggtgctcgctacttcttcaacaagtggacgccggactatgtgtacgtcgagatgacggtggagttccgcgacgacaagaaccgttggttgaacccaggcaagcgacgcaacgaagcatgggatttggcgtactactgcctcggcctctgcaccattctgaaggtcgagcatttcgattgggacaacccggagagctggtacgacgagtggagtaacaactctcttgtgcgacctgccgatcaggaaaagaggtttgcgtcaagcccgactacggattatggtttcggtcaattcggagccaccctgggatgacgcacaatgaccctcgaacagttgcaagccatgcttgcggaggcacaagcggcctatcacaccgccatgatgggcggcgcggtgacggtcgtggtcgaccagaacggggagcgggttgagtacagccgggccaacccggcatccctgctgaagtacatcgccatgctccaggctcagatcaacgccatgctgggggtcgcagtaatcggcggcccccttcgccctctcttttaaggcggcctagaccatgagccaagacctcgcagtagtacgttctccggagggcgatgccgccttccagcgcacgatgaacgacatgattttcggcggtgccttcgagggcgcgaagaacctcaaccgacagaccgcgttgtggtccgcgccctcgctgccgccggacatggaaatcacgccggacaaagtgcgcatggatgcgcgcacccgcgatctgattcgcaacgacggctacatccagggcgcgctcgacacgagcaaggactccatcgtcggcggccagtaccttttgaacgctcggcccgactggcgctcgctcggcttcgacgaaaagtgggccgaagagttccagctcatcgccgagcgcaagttcatgctgtacgccgagtcgccgatgaactggattgacgcctcgcgcaagaacggcctgacgggtctcgtgcgcatggcgctggcccaggcgttcatggcgggcgagacgctggcgacttcggagtacctgaagggcaacggccgtccgtacaagaccgccatcaacatgatcgacccggatcgcctgtcgaatccgaacgacaatagcgacactgcgttcctgcgccgtggcgtggagattgatcgtttcggtgcagcccaggcgtaccacatccgcgacgctcacccgatggaatcctactacgaccgattcggcgcgaagtggacgcgcgttccggcgttcaagccgtggggccgcccgcaggtcatccacatcgccgacatcctgcgccccggtcagacgcgtggtgtttcgcagatggtggcggtgctgaaagaaatgcgcatgacgaaggtctacaaggacatcgttctgcaaaacgcggtggtcaatgcgacctttgctgcggctatcgagtcggagctgccgcgcgagatggtgttcgcgcagctcggctccggcgacatgacgtggttgcagaagtacatgggcgcgctggccgagtacgtgggttcttccgacaacctcgctatcgacggcgtgcgtatcccgcatttgttcccgggcacgaagctcaacctgcaaaacgccggtcagccgggcggcgtcggcagtgacttcgaggactcgctgctgcggcacatctgcgcggcgctgggcctgagctacgagcagttctcgaaggactactcgaagacgaactactcgtcggctcgtgcgtctatgatcgagacgtggaagttcatgcagtcgcgcaagaagctcatcaccgaccgcttcgcgacgatgatctacatgctgtggctggaagaggaaatcaaccgcccggagaccgatctgccgatgccgaagggtgccgcgcatttctacgagggcatcaatcgcgaggcgtacatcaagtgcgactggatcggcgcatcgcgcggccagatcgacgagctgaaggaaacccaggccgccgtgctgcgcatcgcatcgggcctgtcgacgtacgaagacgagctgggcaagctgggcaaggactatcgcgaagtgttcgagcagcacatgcgcgagcagcgcctcatcgagcagaagaagctcaacttcacgatgtcgaccagcaagccgggcacgcagaaggctactgacagcgccgcgaacgatgacgccaaggcggacacggctaccgaaaccgaaacggagaacgacgatgaatgaattgctggcgatgcgcatgtcgatcatggagggcttcaacggccgcccggccctgatcgcaccgcaggagatggagaatatcgcgacgatgttctcgtcgatgatgcttcagcaggccccgccgaccgccgaacagcgcgcggcggctgaagaggcccaggtggtgctcatggagcgtgccttcgacatctcgttcccgcgcgagcgttccaaggcgtttgccttcagcgacggcctcgccttcatcccgatgcgcggcacgctcgtgcatcgtaacggcgactcgtggtacggcacgcgcggctacgacgacattcgtcgcgagttcgacgctgcgatggccgacccggacgtggcgggcatcgtattcgacatccattccggcggcggcatggtctacggcaacttcgagctggccgatcacatccgcagcaagcgcgccgagaagcccaccctgtcggtcgtcaacgcgggcgcgatgtctggcgcgtattcgctgggcagctcggcgaagaagatggtgtcgaccccctccggcgattccggcagcatcggcgtcgtcaccatgcacgtcgatctgagcaaggcgatggagaagttcggcgtcgccatttcgctgatccactccggcgaacacaaggtcgacggaaacccctatagtccgcttcccgacaacgtgcgcgccgacatgcaggtgcgcctggacgggatgtggcagaagttcatttccgtggttgcagctaatcgcggaatgtccgaacaagcgattcgtgacacgcaggcccgcgtctatggcgcggacgatgcggtcaaggtcggcttggtcgatgcggtcatgtctccgcaagaggcagtcgcttccttccgggccgaagtcttcggctcttccaccagcgaaaacaggagtcccaccatgagcgataccaagaagcccgacgccaccgtcgaagagcagaagaagaccgacgccaccgtcgagcagcagaagaagaccgaagagaaggtcgaccacgctgccaacgagcgcgctcgtatcgaaggcatcaccacctgcgaagaagcgaagggccgcgaaggtctcgccaaccacttcgccttcaagagcagcatgagcgtcgacgaagccaaggccgcactcgctgcgtcgccgaaggcgtcggcctccaccggcaagtccgcgctcgacgcggcgatggaaaagaccggcggcggcgctgacatctccaataacggcggcgacggcgaagacgaaggcgacaagggcgagaaggccgatggcggtctgctcggtgcctacgcccacgccaccggcaacaagagcgtgctgaaggccgtcaagtaaagaacaccgtcgccagcctagacgggaaaaaccggctacctagtccactcacaggagtacatcgcaatgaccaactttggccccatcgctggcgtctcggtcgacaacagcaacgccaatggcaacatccagctcttcgctggtgagtccgacatcgttaccacccaggtgcagctcgtgaccggcgtcgcctacgtcggcggtcaggtgctcggccgcgtcaccgcctccggcctgttcgccaagcacgatccggcggcgaccgatggttcgcagaacgcaacccacatcctcggctacgacgttccgacgccgaccgctggcaagtgggaaggtgcgtactcgggcggcgtgttcaacgtcgatgccctgaccttcaacgctgcctccaacaccgtgcagaagaagatcgcggtcttcgacggcacgaacatcgtggcgcagcgcctgtacggcaaccccgccccgaactccggcccggtctaaccggcgattcacccgcaatacgtttcgcacataactcaactgaaacaggagaagcacgatggatttgtatagcactgcggaactgcgcaaggtgatcgtcgacagccggccgcccgtgcagtatttcctcgaccgtctgtacaaggagcagatcaacttcacgaccgaagaaatcatgttcgacgagctgcgtctcggccgtcgcatggctccgttcgtggctccgaacttgcagggtcgcgtcctgaagcgttccggcttctacaccaagaccttccgtccggcctacgtcaagccgaaggatgcggtcaccccgggccgcatgctgcgtcgcttggccggtgaaggtctgaccggcgacatgaccccgggccagcgctggcaggccactgtggccgcgtaccagctcgatcagcgcaaccagatttaccgccgcttcgagtggatgggcgcgcaggccgcgctgtacggtcaggtcaccgtgtcgggcgaagactacccgagcgtgaccatcgacttcggtcgtgccgccaaccacaccgtcatcctgtcgggcaccgccgcgtggagcgactacgacaacagcaacccggacgacgacctggaagattgggccgcgcgtatccgtgaagctgaaggcttcgtggtcactcgcgtcacgatgggcagcaccgcctggaaggcgttccgcaagcacccggccatcaaggagctgctggaaacccgtcgcggctcgaagtcggaagccgagaccggcccgggcctgggcgagagcgtggagtacaagggccagatcggcgcgttcaacatctacgtgtacagcgatgtgtacgaagacgagaccggcaccatgcagccgatgatggacccgcgcgacgtgctgctggaagctgaaggtggcttcgacggcgtgcgtgccttcggcgcgatcatggatgccgacgccggtttgcaggcgctcgacatcttcccgaagatgtggaagaacccggacccgtccgtgatctacctgctgtcgcagtccgcgccgctcatgatcccgagccgtccgaactgcaccctgcgcgcacgcgtcgtcgcgtaaggccgtttcaccagcaacgcccggttcgccgggccgcgctgtttacaccacccaatcaaccccgcaacaggagatgtagaaatggctgacgacaagaagaccaccaaggctgcggccgctggcaagaagctggtcgctcgcgtggcgctgaagggcgacttcgatgccctggatggcctgggcaccgcgatgcaggaaatccaggcgggccaggagttcaccaccgaagacgccaagttgcagaagcagctcgtcgacaacggctacgccaagtcggcgaaggacgcggcgaaggaagaagacgaggctccggccagctctggctccgccccgccgaaggtcgagacgaccgacaagaacgacggcaagaagcagcagtaatcgcgcctgggcgctaggagacggaacatgggctggcttgaaatcaaacaacgcgcgcgtgatgtgacgcacaagacgttcggtatcccagccctgttccgttcggcgggcggcgtgtctacggacacgtccgctcgtttgcactacaaggtgcgcacgtacggcgacctcgaccgcgaaggcttcgcgacgaccgtcgacgatgtggactacgttgtgatcgacactcgcgagctgctggcaaacggcatcgtcgcagaagagggcaaccggattaatttcccgcagctcaacaggactttcaaactcgacgtggagcatccttccgaggacagtcgctacgtcaagtgggcagtaacggagaccgctccatgaccatcggcctgaccatcaacggactcgacgacgtgcgcaagatggtgagcggcataccggaaacggtcgaccgcgcatcggctgttgcgatcaacgaagcgatcacgttcggtcaggccgagagcagccgtcgcattcgcgagcaggttgcgttcaaggcgagctacatcggcaacgcgaccgatccgggcgcgagactgcgtgtagcgaagaaggcccgcgtaggcgacctcgtaggcgtcatctccggtcgtcaccggccgacctctctggctcagttcgagcagggcgcgaagctcggcaaaggcggctacgttcgagtcaaggtttccgcgaccggcggatcgaagcgcatccccggcgcatttccgatcaagctgcggcgcggcaacggcgtgtacgacgccgagaactcgaacgaaggtattgcggtgcggctcaacaagcagggagagctgcccggcggcttgaacaagaagcaggcggtcaacgtgagcggaagcctctacctgttgtatggtccgtccgtcgatcaagtatttcgtgatgttcggttcgatgtgcaaggcccggtgggtgacgcactcgaatcgagcttcctccgcaacttcgggagattgaaccgtggctgatacgaagcgactgttgctggtcaagacgctctgcgattacctgaagagcgaaatcaccctggcgaacggctacaacttcgacctcgcgatggttcgtcgtgacaagcgcaacttcggcaaggagatgaagctgccgggcgtggcggtgctggaaaacttcaaccccgaccgcttgccggaaactatcggcgggttcgtcgggcagaagcacaagtacgatcagatttacctgctcaacggctgggctgacaactcaggactggccgagggcgacgatgagacggatgcggcacatctgctcatgggcgacgtaaaaaaggcgctggggaagttgattaccccgcgcaaccaagacgggttcttcggtggtctcgcaaacacgctgtccatcgaacccggggttgttcggcctcccgacgagcaatccgacaaagcgtacttctggatgagggtccgaatggaactcgtcgagaaggtgggagacccgtactggattcgtgattaacccctgcaacaccacccgaaggagaccacaatgggcagcgagaattacacccttggccgtggcgaactgcgtttcgacaagttcgtaccgggcacccgcaacaagaccggcgagcgttacctgggcaacaccccggaactgaacctcaccaccgagagcgaaaacctcgatcacttcaacagtgaccggggcattcgcacgaaggacaagagcatcgttctggaaaagaccgacagcggcaccttcatcgccgacgaaatcagcgatgacaacgtggccctgtggttcctgggcgacgtgagcgtcgtggcgcaggcggccctcaccgcgcaggtccaggtggttccggccaaccgcgtcaagccgggcacctacatccagatcggcgagtcgctggcgaacccgaccggcgtgcgcaacgtgaccatcaccagcgtcaccgatggcgcgggcacccccgtcccgtacacgctcaacgaggactacaccgtcgactccgagctgggccagctctacgtggtcccgggcggcgctatcgacggcaccgaggcgttcaccatcaactacagcgcggccgcctcgacccgctcgcaggtcgtggtcggcgacggcaccaccgtggaaggcgcgctgcgcttcgtctcctacaacccgaccggcccgcgccgcgactacctgtggccctacgtgcagctccgcgcggacggcgatctggccctgaagggcgacgaatggcagcagctcagcttcgcgttcgacatcctgaagctggacggctacgctaccgtctacatcgacggccgtccccaggtggcgtaaccggggcgcgtcaaacgcggtcaaggccaacttagtcaagaccaagaaggccaagaccaacttcgacaggccgctctccgaaagggggcggcctgttttcttgccagcaaccgaggaagccaatgtccctttcgtcccttcgccttcgcaccatcaccgtcccgtacctgggcgcggatgacgagcagcagagcatcgtgctgttcggcctcaacgccaacgacgtggccggaatcatcatcgcgcagaaagacaacatggaagaaatcttcgacatcgttgaaggtgccggtgtcaagaaagccaccgacctcgctgaagtcgacatgatgcagatcggccagaagctcatggtgcagatgccggacttcatcgcacgcgttatcgcgtacgccgcgcacgagccggaagcgtggatggtcgccatgcagctcgacgcgccgacgcagatcaagtgcatgcgcgccatcgccgaacttaccttcaaggacgaggccggattccgcgagttcctgggaaacgtccaagcggcacttcgcggagcaaaaagcgtggtgccgcacctgcgaaacaaaaatctcgaatcgagcgattcgcagggtggtggctcggaatccgagcagcagtctccttcctgaccgctgaaggacacgctctcgcaggcgagtatccgctgggtgtgttgatcgtagaaacggaactcgcgcgcgagcgtgtcaacaaccgcattagaactgaagcggttttgattcaaagcgcaatcggctccgcgctcagcaagaagggcgcgcaggcattcaaggaacaaatctcggagctataggcgatggccgctcagaacgaagttgaactgatcgtacgtgcgaagaacctcagtacgaaaaccatttctcagctcaatgacgagctgggcaaagtcgccgaaaaccaaaacgaagtagccgatgcgaaccgtctcgccgagcggtcgttcgagagtctgaagggcgagcagcagaagttgctcgctatcatgaagtcgctcaacgaccgctcgcgcaagctggaaggctacgctcagcaagagcagcaggtgcgcagcctccgcgaagaactcgcgcgtgctcgcgaaaacctcaacacgctcgcgcagcagtattacaacaccgagaagccgacgaaggagttcacccagcagttgaaggccgctggcagtgaagtcactcgcctggacgcgtcgctgcggaataacgagcgccgcctggaaacgtcgggcgcgaagctgaaggagatgggcgtcgacacgacccgcttcagccagtcgcagcaggaactcaacagtgcggtcaacaactcgctggcgctgtaccggcagtcgaccgacaacatggagcgctacgacaccgctgtccgcgaagtgcggcagcagcaggaactcgcgcagcaggaagaacggcagcaggcgcaggccgcccgcgattcggccgctgctgttgcccaggccgcgaaggaccgcgaagagcaggcccggaaggagcagcgcttcgtcgagctgaccaccaacgtctaccgcaccctggcccgcgagaaggagaaggcggcggccgccggggcgaacttccgcgccaccggcacgcaggctgcgcaggcggcccgcgctaccgccgcccctgccgtgggtagcgggtcgaccctgggcggggcagcagcgggcgtacaggcggtgctggaaccggccaagcaggcggtcgctacgctcgaccagctcgaaaaggccgtcgaccagctcgacaaggagttcgaggccctgacgccggacgccctgaaggccgctgacggcatcgagaagctggccgaccagagccgccgcctgcgggaagcggccgccgcgctgaagggccaaggcggtctcgccgatgacctcgcgcggcagaacacggccttgaccgccagccagcagcggttcgaggaagcgcgccaggaagtgctgcgctacgccgaagccgtggagcgatcggatcgcccgaacgacgagctggcggcgtcgctgcaacgcgcacaggccgcactgcggcaggcccaggcagacctgggtcgacagaccgaagcgttcaaccgcgtgcagcagcgtgcggcggccgcaggcatcaccctggaaaacctcaacggcatcgagcagcgcctcgctcagaacgccactcgcgttgcgaacggccagaagcaggtcgcgcagacgatgacgcagttggagcagtcgaccgcgaagaccagcaagcagctcaacgcgctcaacaccgggcagcgcaccgcgctgtcgctgtatcagcgtacccgtggtcaggtgctctcgctggtgtctgcctacgtgggcgtgttcggcgcgatcaatctggtgaaccaaagcgtcgacgccgccgtggatcgcgagcgcgcaatgtcgcgtctcatgatcgcaaacaagggcgacgccaacgcggcggcgaaggaatacgactatctgcgcaagaaggctgacgagctgggcctcgccttcggcccgttggcggattcgtacagccggttctcggttgctgcgcgcgatgccggtatgtcggcggaagcaacgcgttatatcttcgagtcgttcacggaagcggcgacggtcctgcgcctgagtggcgaagagactgagggcgcgttccgcgccttggagcagattttctcgaagggctacatccaggcagaagagcttcgcggccagctcggcgaccgcatgaccggcgcgttcaatttgttcgcgaaggctatcggcgtgtcgacgcaagagctgaataagatgctcgaaaagggcggcgaggttaaggcggagttcgtgctgctggcggcgcaaactgcgcgcggtatttatggtccgcaggccaaggccgcatcgaacagcttgctcggcgacattaaccgcatgtcgaacgcgtggggcgatctgaagcgtgaaatcatcgacggcggcctcggtactgcgctgcgcagcctgttcgtcgatctgacgaagttcctgaagagcgacgacggtaagaagttcgctgcgaatctgacgaaggtcttcgtcgcggccgctgaagcgggcaaggagctgatcgacgtattcgccgagtacgacggcctgatcgagaccgtagcgaacaccgtcgccttcctcgtgcggaacttcaaggagctgatcgcgatcatgctggcgatccaggcagcgcgcatcgccatcgtcttcactcagctcgctacggaaatcctgaaggcccgtgcagccacggtcgcgctcaacacggcgctcggtgcgggcacggccgcgtctgccggtcgcgcaggcgcttcgctgctggcgctgatcggcggccccatcgcggcgctgctggcaatcgcttcggcgggcgtcatcatcccgatctatttccagatgaagggcgagctgaagtcgaacaacgacaagctcgatgtgcagaagaccgtcacggaactcaaccgtggttttgcggcgtccgagcgaaacctcgcagttctgtcgcgcgacaacaccgagcagttggaaaagcgcgtgcaggcagcgcagcgcttgctcacgatctacgatgagcagaagaagaacctcgccgatcagatcgcgcagaacacgaccatccgcaagaatcaggtcgcgattcgcactgcgcagagcactcgggaaggcgacgccaatctgccgtcgaagcagttcgaggctatccggcaggtcgaggccgagggcaaggcgatggaggcgcagctcgccaacctcgaacgccgtgcggccccgctgcgcgagctggtcgcatcggccagccgtgacctcggcatcgcgaagtcgaaggcggccgcgaccgagaacgatgcgctgtcggccgagttcaagcgcatccaggccgaggcggacgcagcggcaaagcgtgcgggcacggacaccaaggcagcgaaggcggccgaagcggcgcgcaagaagaaggaggccgaagagaagcgcctcgccgccctggccgagcgccgtgtgcgcctggaagaagacgtggccgagaagctgcgcgacatcgacagcgacatcgcccaggcgcgcccggatacgctggaagaccggctgaaggtgatcgacaacaagatcgctgatcgcaaggcagagttggagcgcatgatccgcgaggcggaaaagctaaacgtgcccgatgcgaagaaggaagcgcagcgcggcctggacgcactgccggacctcgaaaagcagcagaagcagttggccgagcaggagttctacgaggctcgcatcaacaccctgttgcagcagcgcagcacgtccatcgacacgatcaacaccttgcaggaagccggtctgctgacggcaagcgaagcgtccgcgcagatggaagaggtcaacgctcgtctgctgccgcagctcgaagctctgcgactgaaggcggtcgagttcatggctacgctgggcgatggcccacaggcccaggctgctcgcgcgaacctcgaaaacctcaatgcgcagatcaaggcgatgtcggtcgagatgtcggcgactaagcggaagatcgtcgacgtgttcaccaacggcttcacgaacgccttcatggagagcgcggcggtgatgtccgactacctgaagggcatccagagtgcgggcgacgcatggaagagcttcggcgacatcgtgctcaacaccatcgccgacattctcgtgcagctcgcgcagatgattatccagcaggccatcttcaacgcgctgaagcaggcttcggagagcgcgagcggcggctggggcgcgatcatcaacgcggcgatgagctacgtgaagcatgacggcggtgtggtcggcgcggcgtcgaagaagcgtgcggtgccgagctacgtctacgagagcgcggtgcgctaccacacgggcggcgtggcgggcttcgcggccgacgaagtaccggcggtgctgaagaagaacgaagaggtcttgaccgaaaacgatccgcgccaccgcttcaacggcggcatggctggcggcagcggcccggccccggtagacctgtctatcatcaacaccatcgacagcgagagcgtggttgcggccggtgctaacacccgcgctggtcgtcaggcgatcttcaacgtcatcaaggctgaccgagcctccttcaagaaactcctgggcaattaaaggaaccaacatgggacacgcaatcggaactgttacgggcggcagcggcgacgaggcgtactacaaggtactcgctgcgatcaagaccctggctgaagcgaacggatggacgacgctgcgctacgtcaacacaggcacgaaccgcgagctgattttgaactcgaagggcttgtcgggaacggaggacatctacatcggcttccgtacctacttcagcacgagcggcgactactacaatatcctcgtgggcgtgttcaccggcttcgtatcggctaacacgttcgacgctcagccgggcgcgcggctttctggcgtgccgtgccataacaacgccgtcacctacttcatcactgccaacgcccagcgcatcgccggttgcttcaaagtcggcacgccggtctacacgcacttctatgcaggcaagatgttcccgtattcccgccccggcgagttcccctcgccgctggtgtgcgcgggcatgttcgacggcgcagcggcgaagcgattctcggacctcgactacgcgttcccgtatcacggtcgtgagagcggcgcgtcttccccggagcgtccttcgctgctgtggctgcgcgatcaggtaggcacgtggcgtcgcctctcgcatttcccgttctataacggcgcggctggctcgaactcgtggaacggctacaacgcgttggcgaactacagctacttggacacggacgtaagccaccgctccctggtcccggcaggaacgaactaccagccgcagccgatcatcctgtacaccaccacggccagcggcgacacctacgcgggaaatgtcttcggcgagctggacggcgtgtaccagatttccggcttcaacaacaacgtggagaacgtggtgcaggtcggcggcactgcggtggacagcaccggcatgaccgtggctgagcacgtcgatgcagtccttgcggcgggcggccgcgcattcgtgatgctgcaagacgtgggtcgaaccgactggcgcagcttcatcggcttggagatgacctaatgttctacaccggcaatttttcttcgttcgtgacgctgaaggcgtcgatggaagcggcgcttcagaaccacggctgggcgctcaacggcgacggcacgctggaaaagaacggcatgtacgtccgcctcgtggcgaccgacatctaccagatcgcagcgttcgcaggcaccggcagcgccgtcgacccgttccctctgccgggcgcggctccgtacggcgtgaaaatcatgaacttcagcggctcgccgatgaacttcccggcgacctatgacctgcacgtgttcgaggaaaccgatgaggtctacctcgtcatcaattacaacggcgacaagtaccagcagttgtcgttcggcaagtctcgcgtcgatcaggtcggcggcaccggcatgtggctcaccggttcgttccgcagtgacgtggtgcaggcggcaacccatctcgtgtacaccaacgcgtcggatagctacgtcggcttcgggtggagcggcatggggtgtggcttgttccacgaggtatacaacgcgcccctgggctgctcctacatccacactggcctggactcaaccgggtggaagcgcgtagggaccagcgaaggtgatttgatgggcagcggcgatccagttgccgctctgctgcaatcgctgccgtcgcagttcaaccagagcaccgtgctcctgccgttgctcgcggtgcagcgtcgtctctcgaaggggcagactatcgccgcagacctgcaaaacgcgcgcctgtgtcgcaacgacaaccacctgtccggcgaaatcgtgacctacggcaccgaccgctggaaggtgtacccgttccaccgtaagaacgcagcagtgcgcaacggcgtgccgtggtcgaccggcgcggatcacagcggcacgtttgcctacgccattcgctacacggggccgtgacatggcagcacgtatcggacaaatggggagcgcgtttgagcggggcatcgacaacccgatgctcagtgatgacctcaacaaactgactgaagtcgtgtcgatgttcgacagctacgacggcggtcgcttcttgcagggccgctacggtagctggcacgtgcattcgagcaaccaccggggtgtgtcggcgcagcgcaagatgacgagcttcttcgacgactactacaaccgcatcttcatcgtcccggccgccctggatgcgggcaatctgctgtccacgcaggtccggcacatcatcctttggaatgcctacgtcacgccgcagacgttggagtcggccgtgctcggcccgcaggcaggcatttcgatgtctcccccggcgggcgtcagcattccgttcgagatgccgccgctgcgtgagctggatttcaccgttcagatcgaactggcaggcccgccgacgatcagcagctatgcgcgcttcaccgtggaaggcgtcaactacaccgtgccgatcaccggccgccgcatcgttctcttcccgttctctccgaattgggggtctccggtcgacgagacgatcacgcatcgctcgtgggtgctgtcgtcggacgacggtagcgagcagaccggtagcgagtcgggtgaagtgccgcgacgcacgttggagttcaacatcaatctgcggacttctaagcaggcccagcgcgccgagaatctgctgttcgcatggcaggcccgcttcttcggcgtcccgcattggggcgaagagtcgcgtaccgacgcagccgtcgaagcgggctcgctcgttatccccttcaacaccttcggcctgtcgctcgaacccggttcgctggtggcgctgtatctcgacgacgaggtgaacgaaatccgcgaagtgcagcaggtcactgctgacggcgtttcggtcacgaccgggttggagtacgactggcctgccgactcgcgcgtgtatccgtgtttcgttggcctcatgagcgaagagatgtccgagcagcgcgagacttcccgcgttggccgcatggcgatgtcgttcgacttcgagccgagcgtaacgccgggcaacgcggcgatgaacccggacccgatgacctaccgagggcacgagctgtacatcaaggagaccaactggctgtcggcgatgcctttctccttcagcgcggacacgaagcgcgtagacaccggcacaggcaagttcgttgccttcaccacctcgggcttctcgaaaatcagccgccgccataactggacgctgttcgaccgcgctgacattttcgagttccgtcgtttcctcggccgtcgccagggtgttgctcgttcggtctacatgccgagcggcaccgaagatttcacgatggcggcgacgatcctcgacaccgagaactcgctcgtggtggagtcgaacgaatacgcgaagctggtcggtgcgcatcctgctcgccgcgacatcttcatcctgttgaagaatggtcggtatttctgtcgtcgcattacgctggttagcgagttcgacaacctgacccggttgcagctcgacagtgcgctcggcgaagaggtgcggccgcaggatattcgtcggatcagttttttgacgctgtaccgcttccagtctccttccaccacggtgcgctacctgaccgattccaaggccaccgtcgagtcgatgctggtcgccaagatgaccgaggactgatatgtctctggcccaatacgaaagcagcaaagaacaaggctctcgcgtggagctttacctgtttgagagcgacgacggccgttaccgctgggcgtacaccaccgatgcgcgggagcgctcgattggcccgattacttacaggcccgaagcgattaaacgcggcgagctgaagcagaccgcaggcgatgccaacgtcgagagcctggaagtcgtcgtgccgttcgacaaccccgtggcggccgcgcacgtgccgtatctgccgcctcgccctatcaagctgacgatctacgcgtaccagcgcaatgaccccggcgcggaaatcgtgcaggcgttcaccggcttcgtgacgagcttcagccagaagggagctgacgcgacgctgcaatgctcgcagatcatcgacaacctttcgcagacggtgccgtgggtggtgttcaaggtcggttgcgtgtgggcgctgtaccagatcggttgcggcgtcgacaagtcgctgtggcggcgtgatgcgctcatcaccaccgtggacggctacacgctcggctcgcctgagttcgcgtccaagccgaccggctactacaccaacggcttcatcgtcgaccgcgagaccggcgagcagcgtttcatcacggcgcatgacgcagccaccgccacgatcaaggtcgtgtatccgttccaaacggtgcagggcgggcagattctcgacgtgtacgcaggctgcgcacgcacgaaggaagtctgctcgggcaagttcaataacaagatcaactacgtcgggttcgatcacttcccgacctacaacgtcttccagcaggggatcacctaatggcctggatcgcaattatcgtcgcaatcgtcgtcgcaatcgtcggcgagctgctgcggccgaagcagaagttcaacgacccgaacccatcggccgtgggcgacttcaagttccccaccgtggacgcctcgcgcgtcgtaccggtgtggtggggcacctgcaagatgatggggccgaatgtggtgtggttcggcgacctcgaagtcgtgacgctgaagaagaaggtcaagaccggctggttctcgtcgaagaagatcgtcaccgggtacaactactacctgggcgtgcagctcgtgttcggctacggcccggcagacgagttcatcgaactgcgcgtagacgacaaggtggctgaccttgtgcgctcggtgttcaagtacaaggacacgtggctggccggtcaggtcgcgagcaaggagttcgtcggcgacaagtgcgagttctacatctgctcgccgtccattctcgacaacggcgacccgccgagcggcgtagttggcaagtgcgttctgtaccaaggcacgttcacgcagggcacgaacaactacctctccggccagtggaacgaaccggacatgtccgcgttccgcccgttggtgcatatggtcatggagaagtgctacctcggcaacagcgacacgccgccgcccatctcgatcattgctcgccgctgcccgaaccagctcggcctgaccggcggccgccacaacgtcaacggcgacgcgaatatcgcgtgcgcgtcgtatgagttgatgaccaacaacatgtggggcatgaaaatccctgaagacaagatcgacgttgactcgttccgcgcttgcggcaacctgctggctgaagagtcgctgggcatttcgatgctggtgcagtcggccatgctcggcaaagacctcctggccgaagtgctgcgccacgctgacgccgtggtgtacgccgatccggtcaccggcctgtacacgatgacgctggcccgtgagttctcgcaggccgagaaggacgacctgctggttattgacgacagcaatatcctcgaagacagcttcgacttctcgcgcacgtcctgggagatgacgaagaatacgatcatcgttgagtacaccgaccgcgcctcgttcgagaccaagccggtgcagtaccaagacctcgccaacatcgacgtgcgcggcggcatgatcgacgcggagaccttcagctacctcggcttcagcaatgacactgcggcgatgaacaccgctgctcgcgtgtcgaaaatgaaagcgtcgccgctggtctcggcgaagatgtcgctcaaccgcatcggctacaagctgcgtcccggctccggcttctggctgcgcaagccggatcgcggactggcgaacgtgctcatgcgcgtgatcgaaatcagctacggcaccctggacgacccggcgatcaagatcaccgcgatggaggacatcttcgaggtcaacgctgtagcgtacgtgccgccgggtccgggtgattgggttccgccggttactgctctcgcaccgttcgctgcgcagcgcgtgatcgaagccccggcattcggcgctgacgatatgagccgacgctttctcatcacgatgggcgtgcccgcgagcaacggcgtcatcggctacgacgtgtggagcgaccccagcggcgcgtcgaattaccagatcaccaacgtggtcgagggctacacgccgtctgctgttctcttggccggtctgtcgcgcactggcccggaagtcgacaccgcaggcttcaccgtgtcgtcggccatcgggctgaccggtcttgacccaggcaccgatggttcgcgagaggcaggcgagaacctgctgctggtcggcaacgaactcatggcatggaagaacatcgtcgacaacggcaacggcacgttcacgatcaccggggtgtaccgcgctgtgctcgacaccatcccgcaggatcacgctaccggcgcacgcgtgttcttcctgtccgaaggtgcgggcacgaccaacgtcgacggctactcgggcaacgtcacggtcaacacgaagctagctccgaagaacgtgtcgtcgtcgctcgacatcaacctcgcagcagccgtcacggtcacgaccaactcgcgctctctgcggccgctgccgccgggccgaatccgggtcaacgccgcgccggtcggtgctggatcggccttcaccggggacatgatcttgacctgggcgcaccgcaaccgcctggacgggactatcgcctcccaggccgatccgtcacgtacgccggaggaagggacgacctacaacatccgggtctacaccggctcgaacgccctactggcagaagcgcttgcggtctccgacgctgctaccgccgcgaccatccgcctcgcagtagcaggagacatgcgcatcgaaatcgagtcgatgcgggagggcctggcctcgtggtcgaagcaggtggcctacttcagctacactccggccagcggcacgatcacgaacaccatcgcggtcgacgagccggagtacgttcttgacggaggcggcgcgtaatggcccaggtagttgttgcccaacgcatgtggcagcgccgcgacgtagcggcgaactggcaatcgaagaacccggtcctcgcggccggggaaatcggcgtgcagctcggtgcgacttcggacgagaccaagttcaagatcggcgacggcgtgacgccctggaacagcatcggtttcttcgaggggcggctgatcgaaatcggtacgggcggcggctacatccgctggcgctacgtcggtgacgagaactggatcaacctcgtgtcgctcgaatccctgcgcggcccgcaaggcaacgcaggcgcaaccggcgcgaacggcctgagcgcgtatcaggtggcggtggcgaacggattcgccggtacgcaagctgagtggctggcgtcgttgaaaggcgcgaagggtgaccccggtatccaggggccgcccggcatcccatcgcagcgtcgcatccagagaatcactgacaccaccagcggctcggtcatctgcgactggaactcgtacgacgaaatccgagtgacgctcacggccaacacgcagatcaacatggaaggtgctctggacggccagggttgcgttctgttgctgaagcaagacgctgttggcggccgtgcggttaccttcagcaacaatgttcgattcaacaacctcatctcgacctacaacgccacttccacgccgggaaagtctgaccgcatcggtttcgtgtacgacgatgacgacggcttctacgatgtgcaggccgtggtggatggaatctgacgatggccgacgaatacaccccgccgctatcgcccaacatcgtttgggtgttcaagggcaacgagtacaacccgccgctgtcgcccaacatcgagtggattttcggtgctgacgatgacggaggtggcaacgagttgcgcaagtcttcctacatgcttctcttgactatgtgaggttctgaaatgactgttcgagtttattcctcttctgacgcagacgctccggtccttcgcggcaatacgcccggcgacctcatcaacgtgctcgaaaagtgcctcgtcaccggctacggcagcaaggcgggcgcgggctggacgaagccgttcgctggcaccaacgtggccgcattcaagcaaggccctggctccaatggcatgtacctgcgcgtggacgacaccagcaccgccaccagctaccgtaaggcgaaggtcgtcggctacgaggtcatgaccgatgtcaacaccggctcgccgtcgcccttcccgactctcgcgcagaacccgcagggcggcaattggttcacccactacagtagcggctcggtggcgaacccccgcccgtggacgattatcgcagacgagatgttcttctggttgttgctgaccacttacccggagagcggcacgcagtattaccgcgagtgctacgcgttcggcgacatcatcccgttcaagccgggcgacaccacgcacaccatcctgttgcagaacgactcgcccgacagccccaactcttcggagcagtatccgttccagggttacagcatttcttcggcgatgaaccgctaccgcctttcggttgcgcgtgacttcaccaacctgggcggcccgatcacgctcggctggcacaacgatatgaccaagggcaacagcagttggggcaacggtaacctcagctatcctcacggccctgacggcgggctgtacctctctccggtgtgggcgcacaacccgaatgtcggaccctacagtattcgcgggatcatgcccggcatttgggttcactgccactacttcggaatcctgcccgatggcgcgttggtcgaaggccagggcgaactggcagggaaacagttcctccatcgggtgcactaccagaactccgcgttgtttgaaatctccgacacctgggatcggtaaactgaaatgctgctcgccaacctacccctaagctcgccggaaggatcgacttcgtacgcagacgctacaggtcgattttggagcggctacagcgtcgctccgatcatcatcgacggagcggcgcgttttataggcgacggtctgatctacacgaacagcggcggcgatttcctgctcggcacgaaagatttcgacatcgctttcgacatccagactacgagcagtacgctctccaccgttctagactacctgaccggcagcggaagcacgtggcaggtgtatttcagcaccgaggggcgtttgatctggacggcggaaggccccaacgaatcgccggtaatcggtacgacgagcgcggttaacgatggcaactggcacaccgtgctgttccgtcgaagggacggtgtgctgagcgttttggtggacggcgcagtggaagcgtcggtgcctcacgcccgcaactacaactacgcggtcagcacgtttgcaatcggcggtcgtttgtacttgggcttctcgtatattttcaggggcggcattcgcaacgtctacatcaacgtcatcgacccgccgcctgcacccgcacgcctcgccgcgttcattcgccgcagccgcatcggctgggacaaagtaaccaaggttgattcggtcaagaagatcgaggtctatcgcgcgcctccggccagtttgcggaaggtgcagaccaccaagtcgacgcgaggtgtcccgccatggtggggcgctccggggtcgaccaacgtgctgccgacgtacaagctgcgcggccgcgtgatgcagcgagacccggatacgcaagaagacacgccgttgcagaacgtgcgcgtcgctttgttctaccgccgcctgcatacgctgatcgacatccagctctcggatgcgaacggctacgtgcagttcaacaacctcatgcccggcgtccaggcgtactacggaatcgccttcgactcggacggcggcatcatgcagaactcggtactgtgggatcgcctcacgtccgaacccggcccttaattaatcaggagaagcaccatgaccgactcgaagaagctcaccgacgctgacatcgcacgcgcagccaaggcccttgttgtatcccaggcgaaggtgcgcgccattctcgatgtcgaagcgccacgcggcgggtttcaggacgacgggcaggtcacgatcctgttcgagccgcacaagttctcggagtacacgggcggccgcttcgacaagagccacccgcacctgagcaatccggtgtggggcgcggttccctacagcagctacgccagccagcacggcaaactgcaacaggccgtggcgctcgaccgcgacgccgcactgcgcgcaacgagctggggcatcccgcaaatcctgggcaacaactggaagaaagtcggagcggcatcgttgcaggatttcatcaaccgcatgttccgcagcgagggcgcgcagctcgacctcatggtggcgttcatccagagtgacaccgagttgtggaatgctttgaagcgcggcgattgggccaccgtcgcgagaaagtacaacggctcgcagtaccgcaagaaccaatacgacgtgaaacttgcagcagcccatagaaaattcggaggaaactgagatggaaatcaaaccgcgaatcggtgccgacttgtggcacgccatcacccaaggcacgacgctgaaggtgcgtttcattctcgccctgcaaagcctcatcttcggcgcgagtttgctggtccggcccatgcccgccccgacccggtgggcgctgttcgccacgctgccggtctacgcatggtcggcaatgctatggctcagcgggtcgctcatgctgtggcgcgtgctctccacgcggccggtgacgtggctggcttgggcctccaacgtgttcgcgctgttcacttggtttatcatctgcctgtcctatgccgccttcgagggctggcggggcttggttggcacgcacatcctggccctggtcatggctgttttctgcgtgctccgtactgaggcgactcgtagcgatctggaaacagcgtgatggacgttgagctggaagctgcggtcgacaacatgacaggggaattgacggtggatgaaacgaacgcctggaagtgggtggcggcactgctaggaacgctggtgaccggcggcgtcggttgggtcatcaagaggcagcgctcgggccagattctcgacgacaccgagaacgcggccaagactgatttgatcgagcggttgcagaagcggaaccgggagctggaagaacaactcggtgagcttttcaacaaaaccgccgccgggtacaacgaaatcggcgaagccaagcgcgcggccaacatggcgagcatcgaagctgacactgcaaaagccgctgccgcacgcgcatcggaagcagcgtcccacgcgcaaaggatggcgcaggcggccgacgacgtttcagcgaaacgactggtctacatccacgagctgcgtgcgttgctcgtcgccaacaacatcccgttgcccgcgtggccggagggggttctatgagctggttgttgaacacgaggctgggccaggggttgatcctggccgtggtgattctgctctgctggtggggcttcgcctcgcactacgaacagaaggggcgtgacgcatgcaaggccgagggcaacacgcagtacatcaagaccgaggcgaagggccgcgacgtggcccagcaggcggacaaggaagccgcggcggtcgagcagcaggccggacagacgaaggtcgagaccgtcgagaccatccgaaccgtctaccgcgaccggatcgtcaccaagccggtcagccccggtagctgcgtccacccggtcgacccggcggtgcaggccgagctgctggcccgctggaaggacgcgaacgggggtgtgccatgaccgcccgcgccctggtgctggcggccgccctggtggccctgtgcggctgcacgcaggccgttcgcccggcaccgcctaccgtggactgccgacaggccgcctcgacgcccctggaccccctaccggcggctgacgagtgggtggagtgggtgccgcccacccccgaacggcccaacggcctcgcccggctgtccgcacgggccgccgagtgggttgccagtacgctggtagcggtgaagcgggaacgcgccctggcggccgtgcaggagcgttgcctggacgggtacgagaaggcgggggcgatccgccggtagttgacagccccggcggtcggggatagctttagggccgctggtcgcacttcgcgttgcatcggcacctcggtagggaacgcaggaagagaatcggcgctcagcctgcaactggaaaccccggactaaacacccggggttttcttttgcggtcaaggccaagttggtcttgccccggttggtcttgaccgcaaaagaaaggccccgttgctgagacggggccttccgggggtggcgcgactctcgtcggtggccgggtgtcgactgcgtggttctgctgattccggttttcgctatgcgctggtccggctggaagggcaatatcgcttcgacgactcgaccataaggccgcgtgggtcagcgtgtcaagcgtccgtcgatcacctgttccaacttgccgcccaggtgttgcagcgcctccaccatctcgcgccactcgaacatgtgccgcgtgcggaacgtaccgaacgcatacaccgtgatgccgtcccagcggcggccccggatgtcgttgaggctcgctacccgcttccactcgccgcgcgatgcgcctttgatgtcggcgcactgttcggcctgtctgtcgtctccggcgatgatgtagatcatggcttaccccttgaacttctcgacgtgcttcagcattttctcgcgcgtctccttcagtccatcgtcccacgtcttccaagccgccgcgtcgatgtggctcaggatttcgtcgcgggccatgttgctcagcacggtgggcggcagagcgtccagctcccagctcgattcgccaaatcgcttgcggtaattcacgaaacgcgagtccgtggtttttgccgggttcggcggcggcttcaactcttcgatctggtcgtagttcaacgccatgcgcttcaactcgaactcgccgcccaggccgaacaactggaagcgttcgatcaggtcgcgcgtcatgtcgatgccgctcgggtcgtggtcgccgaagtgcaggatcagcacgtccttgtcggcgttgtgttcgatttcccgccgcgcgaaatcacgcacaaccgatgcgctcgggtagccgcgcgccgcgagcagcggcacatcgtaattccagcacacgttttggaacacgccgaccagtgcttccttctcgactacaaggaaaatgcggcggtcctgcgcggcccacgggtcggtgtggtactgcttggcgctggccgtcaggatgtccttcgggttattccaacgcccgcgcgcctcgaacgaacgcgtgcggtcttcgatggcgtcccaatcaaccagaccggcgatgcggccatcgttgacgaggcgggtgatgtacttataggacttctcgttgttcggaatgatgtcgcgggcaacgagctggtagtaaagctggcgcactgtcagcgtgtagccttcgtcctgatagacctcaatgatgccgttgatgcggtcgatcatttcgaggctcttcttcttgaacgtgatttcctgatacatctcgcgcatggcactcggctccggttgttacagcatgatgctcatggaatcgttgaaggtgatcgtgcgctcgtcatcggcacagcgcgtctcttccttcttgatgttcagcgtttcgctgccccgcacgcacacgaagccgtccttagtgacgttgcagaacccggcgctgtggacttcgacctcgacgttggccggtcgaagctcgatggtgacgtgccgcttcatcgccttggcgatttccgagtgggtcaggtgctcggagaagatgaaggggaacgccttgctcacgtccatgtcggcgaacgtggccttcaggatgacgtacttcatacgccgcctcgcttgcggatcgcggtcgcgctgatcgactcgatttcttcagtgaggcgaatctgctcgaccttgtagccgacatcgcgcccgtagtacacgccgttgacgttcggcatcgggaacacgtggaagcagccccggcggtgctgaagcgcggcttcgatacgcgtggtgaccgctacgccgtccagcgggttgctcgggccgttcggcatgaagcgcacgccgatgccgacgtagccttccttcgcgagcacctgctcgaacagcgccgcgtggcctgcgtgccacggctggtagcgaccgatcatgagaccctgggggatcatgaagcggatcgcctcggcgatgtgacccatctcggtcgtgtccgcccaacgttcggtcacgtagtccgcgttctccggcggcacgaacatctcgttggtgtccgggtagcggctctcggcaagggtgttcatgaagacggtcaagtccgctccgaacaccgcgcgaatctccggcgtcggcgcaacgaagtcagacacaaccagaccttcgtgcgtgtcggcaacagcgcgcatgcggtgcgcctgctccatgcggccttccagcgtgaagtcccaattgttcgccgcctcgcgcacggcatcgccgttgacgtgagcggcgttgaggcgcgcggcgagttcccgcgcgaaggtcgacttgcccgagccgggcaggccgcagatcagaatacgcttagccattgtgctgttccttttcgatgcgaagttcttcgcggatttccatgagcagtttgccgagatggttctcgcccttcccgtcgcacacgccccaatacttgtcgccccaccaattgccttcgacgagggttgcgttgccggtcttcagcagcttcgacttcagcggctcggtgccgaacttctggcggagcagctttctcatgacgttgatcttgttctcttcccatccgtcgcgcagcactacgcgcttaccgcgccgcttcgcgcctgcggcgtccggctcgttacggatgcgtcgacgttcgtccatgtcgtcggtctttgcagcctggaacgcgtgctcgaccgtccggtaggagtggccgtcgaaaacgacagcgcacgaccagaagttcgagaggaagcgatacgggcctgcgaagctgccgatggttttcatggtgcctcctagtggatgatcttggccttgccgaacaggatgcgctgcttctggatgtcagtgcgccggatttgttcttcgagcgagacctgcacgttggtcttcatcatcgcgtgcaggtggcgcggctctacgaccttcccggtgacgaacttgtagatggccgagagcagcgacgggttatgcagctcgaagaaactgccggtaagcacccaggggttgtgacggatgctgctggcgatttcgatgagctgcttctcggcctttcgcagatcgagcggcggcgtgatgcccagggtctccatgctgtgcgccacttcgcgcgcaggccgatggacgatcaggaactttgcgccagggaaccgcacgacgagatggtcgaaaaagaacatcgcggccacgtcggagatgaaagccgggccgggcggcatgccgtcaacaaccaggcccagctcgttgatagacgcgcactgctgcaacgggttgtgcagagacgcgcagccgtggccggtgcccgggcggacgaacgcttccatccacgcgctgcgactgcgcggcaggctcagcatgatcgtcaggtcgtggtactcacccatcggcgttctccttcagccgcgcttcgagcaaatcgcgcatggccgatgcgcccttgcccagcggcacgtagaaatggacggtggtgctgtccatcgcatccatgaagaagtgcttctcgtactcgaaccggtgcgagggggtcggatcgccgacaggcagctcttcctgcttgacttcatgcgagtagagctgcggcggcgaggccgggaacaggaggcgctggccgtccaaggggccgccgatgaaatacgcccgcgcgctcatcgctcgcccccgtccccatgcagcacgccgcgctccttgcggtcggccagcttgtcgcggttgcccttcagcaacgccacgtagccgccgctgccgcagtcgaccaggggtgcggtgcgctcggcgaactcgaacgagacgttgaccatctgctgcaatgcctgccgcatttcttccagcttcgcggcggccttggcctcgtcccactgcatgccgtcgcgcatggccttcttgacgacaccctggacgatgcccgcgtgagtgcagagcgccgattgcagatcgaagccactgatccgggcttcgcggtagtgcgcgtcggcgaggcgcgtggctgcgttgcgcaccatgatggcgaacggcggcaggcccttctgctcttcgcacatgcgggcgatgtaccactgcacgtcgcccagctccttccacgccttcgcgtatcggtcggcgcggtagtcgggcttgaccgcttcttcgtcgaacagttcggccagttcgccgacctcgttgccgatgcccagggcgacgtacaggacgcccgcagtgatcgcaacggtgctgagcgtggtcggatacttcgcggtggtctcggtgaactcggcgtagcctgcggccgctgcgtgggcggcgttgacgaaggccagtcggtcttcccgcttcagagaaagagtgctcatgtgggtctctcaggtcagggtgtggggaaagtcggaggcgtactcaatctcgaacaccttcgcgtcgtcgtgcagcaccagcgtcggctcgccgtgcggcggcgggacaaccgcgaagtcgacaccgcgcgtcagctccgtacgcgagcctacgccgtcgactacctgctcgacgaagatgcgcacgtggtcggggcgctcgcgagcggccagtcgctcacgctgcaagatgcgcttggcgaccttgccgccgaacgccttgcgcagcttctcttcgacgctgcccttgtcgcgggtggcgaagatgccggtgcccggcttgcccggcactccgcgcttgtcggcgcgattgtcggtctcgttgtcgcgctgctgcaactcgaacaagcggcgctcgtctgccgcgagctgcttcttgcgccacgggctgagttccttcccctgcgcttcgagctgcttctccttgtcgtacgtgcggaacacgcgacgcaggctgcggttgatattgatgtcggctttcatgagtgtccttgctgcggatatgaaaaagcgacccggccggtattcgacagggccgctcgttgtactactcggtcaaggccgacttagcgaccggcgacgaacttggtctgcttctgcaccttgccgcgcttggtctcacggaacagcacgatggtcgtgttgtcgtcggccatgatgctcgcgtcttccagggcaccggcttcggtgatgaacggaccctgcatgccgcctgccttctgcgtgccgtcttcctgcgcggtcagcagcaggtaggcgaactgcttcgcgcccttcttgccccggcgcacgccggtcttcttcgcagccttcttgcccggcgggcggccgcgcttcggagcatcggcggcgaccttcttcggcgcagccttcttgacggccttcttggcggcgatcagcttcttggcacgcggcttggcagcggccgtgccggtggccttggtcttcttcggtgcggtcttcttggcgggggctttcttcgccgccttcttggttgcttcggtcactgcttcagcggtggcgctcatcgggtatctccattgcgttgttgtcgacaactcgcgggatgcgagcagggttcccttgcgggattcggttactcgcagcccagcgtggagccagggtgcgaggggctgtcttgcaggtattccttgaagtcgcgccagccgtctttgcaggcaaagccccagcggcggacaatcgagccggtcatgaacagcgtccagcacggctcggtgttgttgccgaacagctcgatcatgtgcatgtgcgtcggcggcagcttgcggaagtcgccagcgtggaactgctgggtgtagtcgaagcggttctcgccttcgcgcaagccgctgttcacggtcacgctgccctcgacgtatgtgcggccgtcctgcggcgagaacaggtcgctcatcgccatcacgtacgcgcccatctgcttgttatcgaacgcagggaaccactcgctcgtgtgctcgatgtagcggccttcgagaatgagcgaggcgctggcccacgggtggtcgtgcagagcgcgctcgtcgtcaccgtggacgaacttgtgcaggtacaggttgagccagcggttgcgcgggatcaggtgccagcgggtcaggtagggtcgacgctcgccgccgttgacgccatccagggtgatgacgcggctcggcttgatgaagcgcgcgtactgcttgaacgcggcgacgaacaggaaccagaggccgagcaggcgcagcgcgttgtagaagcgacgcgagactttcggtgcagtcatgggtgcgatcctcgggatgacggggtagttcattcggcgtccagatcgttttcgttggcttcggtcaggccgccggtcggagccggaaccgcacgagtgacgagctgcggcgcgggggcgaagtcgatctggtagcgctgacggaggaacttcagattttcctcgatacgcttctcgaagatttcggccagctcttcgcgggtcagctcgccctcgtggtggccgccctcgccgacgacgcgcagcttgtcttccggttcgccgtgcgtggtgaggttgcggtagttgtgctgatcgaggatcaacttgtcgagcgcgtcgcggactttcggcaggtcttgcatttcgattttcatgttgtctctcggcgtgagaattatggggtgccgtatcgtggcaccggacgccgggtttgcacttcgtcgcgagggggcgcgcttccgtgctaccgggagactggcctcggcccgtctcgttgcagctcgatcttacccggtggggagtccgaagtaaaatcgctactgcggggccactctatcgccagctccggggcttgtcaacacccctccgcgaatccggcggacggctcagccgggccatctttcgctcccctcggaacagccggtcccgcagcatcttttccgtgacgtgcgggcagttgcgttgaatctggtcgaaggtcatctcttcgccgtcgatccggtagagcctgaccgtccccacgcgcggcagttcacccattgcgtgcgccccgtccgtacgtttcgaggtacacacgatgcagctcttcgtgtgcgatggccttgcggaaccccttctggccgaccagggcgtgcgcgaagtcgtgagcactcggttccgggttgccgatgtgctccgtcatgcgcagcgtctcgttgatgtacgcctgcggctcgccttcgacgtagccctcgtccgcgagcaacccgtggatcgcctcacggtacttccggttgcgatgcttctccgcgaccagggctgcgaacagcgtgaggttcgagagaatccagagcgccgtcgccgcgtccatcactcggcctcttcgtcgtcttcgacttcgcggatcagcgacaggtcgtacatgccgtcgccccacttctcggcggccagcgggccagcctgccgcgcgtcctcggcttcgatgtcaccaacgtggcggccgtctttcacgatgcgatatttgggcattgcagttactccggtttgggtgagatgtgcagggtgtcgagaccctgtttgatgcgcttttccacgtgcttgccgaactcgctcgcatcgccgaacaggatgtcgaggtcagggtcggagcactccgctgcgatgccgcgcattacgtcgagcagcatcggcaggtggtgttgcgagctgtagttctggtggatcatcggccacgcgccttgccgcttccaccacgtcttgcgttcgccctcggtcatgccgacgtagatgtcgatcatcgcgcgggccaggaacggcgaccagaagcaggtatcgaccggcgtgatggagtcgccgaactcatcgagcgcgaagtacaccgcgaagatcggcacgccctcaacggtgtagaccggctcatcgagcatgtccttgtacgtcgcgatggtgtagccccggtaaggagccatgtgttcgtagcggcgcttctcgggcggcgggaggggcattggaaagctctcgttgaagtacgggtctgcggtggcggcggcatgcatgcacgcctgcggcgggtcacgtgcggcggcgcgcatggccgcgtagttgcggtcactcatgcgccgcctgcgtctcggatcagcacgacaggctcaccatcggcgtccccgtcaggcaggcatgcggcgagcacgtcggccgcgccctgggcgtcgccgagcacgagcaactggatggcggcgcggatcgcggtttcggtctcgactgctttgcgttcggccgccagcacgtaccccgcaccgtcgcacagctcttcgagcagatgccgcaaccactgtgccgccgtgaggtctttgcggtccaggctcacgccatacttcttcagccctgcctcggcgcgctggcggatgatcgcgatgaggtcgtccgtggtttgcatgtcgctcatggtgtttctcctagtagcggcgcgtcggcgtcttttcgacaacgcggatgtcgtgggcggggaaagaatgctcgccgtcgttctggtcggtgacgtggacccaaccctggtcgaacgtgcagctcttggcgttgcggaagatcagcggcggcgctccgttaaacgtgatgtcgactcgcatcacagaaccctcgtcgtgatgtgcttgcacgcgccttccgtcaggcggtagtcccacatgctcttgtgcttctcgcccgtggccgcgtcgacgatccacgacacgtcggaaacgccgaaacacttcacgcgtgcgatgccgatccgccagtcgtcgccctgcttggcctgataggtgcaagcctggaacagcatcgcgttgctttcgtcggcctcttccttctcctgcttttcgatttccagcatctcgggcgtgatgagcttcagaccagccgccctcacgtcgatattccgaccgtcagacatgcggatgctcacccacgtgccctccatgttgttccacacttcgttgatggtggcgcgctcgcccttcttgatgccgtcgatcttgcgtgccagtgccgtcttccagtcgccgggcgacatgtcgcggacggcttcgacggtgtagcccgaaatgacgctgataggggcacccgccacgttctcaaagctgacccgacctgcgagtccagcgtagtggtcgttcatgtcaaaactccttgtggaaatctttctcggcccggatgagagccgaaaccttggggccgaactttttcggcgtgtcgagcaggatgtcggcggcaccgattgcgacctggggcgagatgaaatagccctggatcggatgcagcacttcgccgaactcgtcgacgatgtagtaggcgacatgcacgcccactccgtcgagcacgatcagcgggccgccgtcgctgcgcacctgctcgctgtgcagctcggcaatgaacacgtcgcggtatggctggatgcgcttgtacttcatgcggccttttccttcaggtggtcgagctgccagcccgcttcgattgcagcgaagagccgcagctcgctcgcgtcctcgtggtcgagcttcagcagcgtcacgaaagcatcgatcatctgcggcgtcattgggcgcttgtcgtagaacctgcggtacgcgctgttcgggtgcatgtcccacacgtcacacaagtcgacgattcgcttgccctcttcccgcaggtgccgacgcatgatgtcgcgcgtggtcttcgggttcttctttaccgtgatcttacggccggtggatggacggaaactcacagcccgatgtcctccgcttcttccttctcgtgttgcttcagccaatgcgtctccggcaggaacgggaacgggccgagccaaccgataacgttgccgtactgcttggcgaacccgtactgatcgtgccaagcgtcgcgacgccacacacagacgcggaactgcttgtagtgcggcgactggcccggccacggttgcaacagcaccgcgtagtagcccatctcgctcgggtcgtcgagcacttccatgtcgttcagcgagagcggcccgtaccacccgtaaatctgagtgtaggtgcgcgacttgtgcagcgtctcgaaccacccgaagcggtcgttgaactcgaagacgtggtacgcgcgtcgcttgctgttgatcgtcgggtagtcgcaaacctgcacgatgtagaaaccggcttcggtcacgtcttccaaggcttcgagttcgagcattacggcagctccacgtttgtgcgcagcgggcggatgcggggcagcgggccgacccaaccgtggacttcaccgcgatgctgctggtcgcttcccaggtagtaccaatggccctcgtaccacacgaggaacgcgtcgacgacgaggttcacgaccttggggtgatctacgcggactgcgtagacccccgtttcagtcggatcgccgatttcttcgtattgcaccttcacgggatgcccgcctttgccgtgtactcgctcaacttgcgcacccagctcacgcgatcctcgatagggatcgacagcagcgaagcatggccgaactccttcagcatctccttcatcacttcgaggcccttatcccggccgaacgtgttcctgaatgcacgcgaggcgtcacgggacatctcaccgatccaaccttccatctgccggatgcgctggtcccgcttctcgacgttggcgaggcgctgctccgcgagggcttcgacttccttcagcgaatccttgaaggcaatcagctcggattcgacctgcacgccgccacggaacagcgtgcggatggcacggatgatgagcgcgcagtcgtcgtacagcacgcccggcggatcgtagtcgcgccaacccggcacacgacggtccagctcgcggccgatgacgcgaatccaacgcaccgcgttctcgccctcattgtgcgtcagcatgtcttcgcggacttcctgcatcaccgcgccgttgtcgttctcgatgtcgatgtagacaaccggcttgacgttgccctcactatcgagcggacgccatttcgcgagccactgtgcatgatcgcggaaagtgtgcttgttgcgaccgtagtggacgccgcccttatgcgtgtccagcgtcaccgtgtgcgtgttgaagtccccctgctgcacgtcgaccaccgtgtagatgtgctcgctgccgacgcgctggtactgctcgccgaccttcggcggcagctcattgccgtggaagggcacgccgtcaagcacctgctgcgtggcgtcgacaacgttcctcggcgcttcggcttcagcgacaaactcagcctcgacaccgctcgcgcgctccgaccgcaggaacgcctgggcgtcgagctggtacgcgtacgggccgacgctgctctgcggcgacagcggagccagggcggtctcgcggtcgacaggggtgaagaggtcagcccacgagcgcgtgctttcccacacacgatcttccggctcgccgtcctgcaagcagtgcatctcgacatgccagtggcgcacgcactgctgcaagccggtcacgcggtagaacttcgtcggctcagtgcggctctgccagtaggagttgatcgagaacgccgggccttcgttgtagttcttcgagtagacacgttggtcgaagctctccatgccgaccttcttggcccacttttcgaggtcgccgatcacgtcgccagtgtcgacgcgcagctcgatgttgacttccttcttgcctgtgcgcgcttcgatgtccagcaggtcgacgcgcagcaggtcgagaatgcccggcgagagcagcatggcttcagcgatggcgtgcgggtcgatgtcgtcgagcacgatatagcgacggtcattgtccttcaggaagtctatgctgccggaaagcatgtggagctgagtgcccgggaacaggtcgcgccccgacgtggctcggaacgccgcttcgctcttgccctgaccgaagctagaagtaaagccgccggagtggaagcccggctgcggcgacggcacgacgccgttgtgcgattggaacatcacgatgtcctggccggtgaacgtgactttggcccactggaacatgcgctcagcctcggccatttgaccgtcatccaggccgatgtggtagccgcgtcggcggtggatagagaagacaatgccctcgtcgttgcaggtagcgatgaggggcagaagcaccggcttcggtgcgttgttggtgaactgcttatcgtacatatcggcggtccttggttgggttaggtggtgcttacgtggcctgcggcttcgcggtcgagttgcaggtcggccatgcccagcaactcttcgtcccaatcgtcaagcgacatccagccgttgacgtgccagtggaggtcgttgagcgtcagcctgggccagaagtagctgtgatccagtttgttctgctcgatgtagcggttgagtgctgcgccccacttctgcgcctcgacctcgcgccacgtcacttcaccctgaccgtggcacagcatgcagatgcggatgtagttgtcgcggagctgcgtggctccctcgcacgccgggcacacctgcttgtcgcggagccagcgggagagcaggcgcatgcgttgccatgcggccagacggattgcagcgagcagtagggtggtggcagcacgcgcgcgagacaaagggggtactcgggcattctgaaaaaccgaaaccctttgggccaacattttgcccttctccaattccatcacggtgtacttgcgcatggccgttactcggtgcgagtgatggtcaggaacgcgaacatggcgtcgttgctggccgtcatgtacgagccgcgttccatcgtgaagcgcttgcttgcgtgctcgggtgcgctgcgcaccttggcgatgccgccggacagcaccgagttcttcgccttgaagaacgattgcgcctgggacgacagcgtggggccgttctctactacgaatcgacgcacgtggcccagcgactcgccgactttgagcttgctgatctggtcgttgagcgagccgggcaggaacaggacgcgcggcttggcgaccttcggcttggcggcggtgctcttccgcttggccgcaagttccttcttgacggtggtcggcatcttgcgcggcttcttgggggcggtcgtgctggtggtgctggcggatgccatcgggcgaatctcctgtgccgtggttggagtaaagggacaggacaaatactactgcgcggccgggggcagttgtcaagcgcccggttctcggtcgtgaccggccgggagctggccgccctgctgcacaaaggtccggctgggtttccgaagcgggagaaaaattgggtccggctgggtctccgaagcgagagcgcgctggctttcgagttcggtttcggcctgccgtggatttttggaacgggctgactttccgaagcgggggctttttctgtaccggaggcatacgtgtacgcggacgcgcgcacgcacctgcacgcacacccgcccgcgctcctgcacaggtcacgcgcctcacctgcgggcgcgtgtcaatgaacgcgcgccgcgcgcggttcgttctcctggccgcgtcgctcatcctgggaagcgctgaacgccgttcagaaaaataattgaaaaaagtatttgcactactgcgcgaggggtgctgtaattcttccaccggcaggcaacaccgccccggcaactaacaaagggaaagcaaccatgaacgcaacgaaccgcaccgccgccattcgcgaagccgccgccctggctgattcgatcatcgaacagcgcacccgccttgccgctggctgggatcagggtatgaagcgcgacgacgaaccgcgctttaccggcgtcaccccgcgcatgcggatggaacgcgacagcgccgccgctttcgcactgtccgcgcagttcgccaccgacgacgtgcgcgaaggcggcgcggttcgcaacgtggttgccaagctggcccacgacatcgctacccctgtcaccgatacggagattcgcgcagccgccgaccgtgctatggcgctggcccgtgacaccctggcgcagcgtcgcccgttcctgggcgtgttcggtgccgccgatgaatccggcatcgccgacgctgcaatggcgaaggtgtgcggttatgcctatctggcgatcatccagaacaacaccgtgagcatcacgacggacgccgacggcatgctcacgaaagcgtgcctcaatcgtgctggcgtgatcctggccgctggcgacgccgttaacgccctggtgcaggcatgagccgccgcagtcgctccgactatgacgcgcacgcgggcctgtccgctgcgcgcagcaccgcaccgcgtccggtgcgcaagcctcgcgcctcgctccccgtgtcgcgcgtcctgggctggctggcgtgggttgtcgtcgccgcagccgcctatcactacgcgccgcgcgtcgcggcccttgtccgggagttcatctaatgcgcgctttccttatctcgctccctggcgtgccggtgttcaccgtccacgccgatgaccgccgcaccgctcgcaattacgccctgggcttgcacggctacaccgtgcgcccgccccgctttatcaccgtcacccccgtctaaggaatcgcacacatgaccatttccctttcccaagcgttcgcacagtggcaggagttagccgccgacattccgaaggatgacggcccggccctggccgaatcgtggaacgactacaccgattcgctttgcaaagacggcgagttgtgcgcgcttcagtatcactacgcgcccgcctatgacgacgacatgcccggcgaaggctcgcgttacgatgaactaagcgatgatcgcgctttcatcctggaacagatgggcgtgaccatgagcgccgagtttgtgccgtttcacgcgtcgcgcaacaaagatgaaaaatcgccgtcgcttaactggcgcgtgacgctgaagaagggcgaccgcgaagtgttgacgacggattacatgcaaggttgcgggcactgcccggcggaacagcgcaacaatttcaacacgccgaccgtcaacccgaaaaccgaaaagcgcgccgccattgcgcaggaatgcgatacggggttcgaggcgaagggcggaatgatgggcggccagttcaagcgcggccgcaagctagagccggaattggtggacgtgttttatagcctcctgtccgactcgcgcgtgttggattgccgcgacttcgccgattgggcgagtgattacggatttgattccgacagcatcaaggcgcgcgctatctatgacgcgtgcatggccgatgcgctgaagatgcgcgccgcgttcggcgataaggcgatgggcgagcttcacgaactgttcgagggcatgtaatcatgagcgacgttatccactcctataccctggaacgcgacggccttacgttccgcgtcgatcactgcgccgacaccgacaacggcgcaccctgggaaaacgaagatggtcacggcaccgtgtccgactggactacgcgcgacaagtcgccgggcgaattggtgttgaacaccgatcacggtagcaaacgcttttatgacttcgccgacgcgtgccgcatcgcgctgcgcgacggctggggcgcgcgtggcgctgaagagggcatgagtaagcgccagattgccgcgctcgccgctcgcgaggattacgaacaccttcgcgcatggtgcaatgacgaatggagctatatcggcgtcgtggtgacgttgctggacatcgaaggcaacgaaacggacgcgacggattcgctgtggggtgtggacgataatggcgactacgcggccaccgttgcgagcgattgcgtggacaacgtgatgcacggcatttcggccatgctgtatggcggcgacggcgcggtgtacatgagcggttcgcgttcgtggagggtgaaggaatgaatatcgacaaccccgcccacggttacctgcgcgacgcgttgcaggccgcttacctggaatacctcaatgcgtttttgacggttgcacgtttcgccgcgcatcacgacattgacgaaaaaaccgcatgggcgattatcgacatgggccgccgtatccacgaggagcgcaccgcatgaacgtcctgtcgcatggcgaacacgtcgcctcaatcaaccgcatgcataaggccgcagacggctacacgccggaaacgccgtggttgctgctgcacaacactggccgcgtcgaccgcttcgcaacgcaacgcgaggcaaaggaagaagcgcgcaagagctacccccgcgttacgttcgaggtgcgctaatgatgactttctcccttgtgttggtgttgatcctgggcggcgagcggcacacgttcgtcatggatagcggcctgaccgcaggcgattgcgtgcaagccctggtagacaaccccggcgcgcctttgcgctgcgaaaaggagtgaccgacatggccgattccctggaacgtctcgccctcgccatgcgtgcgcaggccctcatccaccgcgagcgcggcaggcacaaccgcgcaaaggaattggaggggttcgccttcgccgtggaaacgtgcgccgccctggatagcgccacgttcgcgccaatgccgtttgccgtcatgtgtcacaccctggccgaccgctgcgccgacatcctgcgcaacgatgatgcgcaagtgcgggcgggtcagttcgagcgactgcgcgacgccgaccgcgtggccgtgtctcgcctgcgcgcttatgcgcatggcgtgggcgatgaggcagacgccgcgcccgaactgtttaaggagacgcgcccgtgagcgttcgcattgtcaaaagcccgggccgcgctaacttcccctgggcggtgcagttcaagccgactgaaaattggtcgactgctgcggcctacgccgacaaggggccagcggtggagcacgccgaacggttgcaggcggaatatccgcatctgccggtgcgtgtgcagcactacacgggagggccgcaggcgtgacgccctacacgtattggctgcgcagcactgaccccaaggcgcgcgtattcgtggctgaagggccgcacgaacgcgacacgtcgctagcgctcaccgcgcgccgcctgggcgtcaaggtgtcgacctcgcgcggcgtggccgtgtatggcctggacacgacgccggttgtgcgcgtggtgaaggaggattgacgcatgaccctggaaccactgaccgaaaccgaaaagcgcaaaatcatccgcgcaaacattctggccgatagtctgctgcgccttgtgcagtgggttgcgttcctggcgatcctgggcgcgcttgtcctgccgctggcagtgcaggcgtggcacaaggccggtgcgatcaccgccgccgtggtgcttgccctgggcgtggcctgcgcgtggcacgtcaagccacacggccgcagctacgcggcgcaggtgcgggacatcgaagcccggcacaagccacacgaataaaaccccgcacccccacacccccacgtctgccactgtctagccctcgctcacgcgggggctttttattgcgcgttcgtctgtccctgggcgctcgccctggccgcctacccttgggcgcgcctttccctggtaacgctatggcctgcgcagtgagcacacctgcgcgcccgcatttgcgcatttccgcattgcgcacgtcctgctgactcgctaacggcctgcacctgggcgcacgtcctgctgatttgtggtcgacctgcggcacacccgatagccctgcacctgggcatttcccgcattgcacgcatttaatttattgcatgggcctagaggcgcgtgtgcgcgtgcgtgtgcgcattgcatttatttcccttttattcgcatcaccgcatggccgcgcggcccgcacgcacgcattgcggcggcgcaggagggtaaaagggatagcggcgatgcgagtaaaaaggtacttccggccctggcgcgggcgtcgcggggggcgctgac

SEQ ID NO: 15 - DNA, 56144 bp, Unknown; identical to SEQ ID NO: 14
  Bacteriophage Xfas105

SEQ ID NO: 16 - DNA, 55589 bp, Unknown
  Bacteriophage Xfas106
cgcgacgccttcgcgcaggccggaagtacctttttactcgcgagcccgctatccctttatccctttcccgcgcgctgcaacgcgcgcagcgcggcgcgcacgcatgcgggcatgcgatgcaataaataaattcggaaaggccgcacgcgcgcacctatgcggcgcagcgctgcattaattccacgttgccgcatccgggcagctatgccgcccgcatgcaaggccgggcagcgaataagcccgccaccatgcaaggccgggcagcgggcaggccggcacgcatgcgagcccgggcaaggccgggcagcgggcaaaataaaagcccggccgcaagcgatgcgggcacgggctcaggcgaagggatacggaaggccgggcagacgtgcggccggcaaggctgctaagccgcgcctagacgcgcaggcaataaaaagcccggcacgcggccgggctcagggtaggcgatgcagggaacgcgccgcagcgcgcttttaatcgtgcggcttgaaccgggcttcaatctcgcgcgcttgcgccgctaggctgcgcccgtgcggcttgacgtgccagcatagcgccagcaccagcgccagcacggcgagcccgctaacgatgccatgcgcccggaacgctccccatgccagcggcaacgcgcccgcgcatacgatggcagcgaaacaaagccagcgcgcgccgcgttctatgcgatacgccagaatgccagcgcgcagaatttgcgccttttcgtttagtgtcggttccgtcatgcgcaagcctcgccgtaggcaatggcatacaacggttcccgcgtgccgcgcgcctgaatctcgacgttgtatccgtcatcctcgacgcataccgcgcccggcggcaggtcgagcccgaacgcgcgcaggttccgcagcaacgcgcgcgggctcaggtcgcaccatgcaaccggcaccgtgccgcgcttgtgccagttattccacgtccagccttcgggctcgcgccatgcgtcaatgctcaggacgtgcgcgcgcggttccgcgtcgccgtatgccatgtcgcaagtgtcgcagtatccatccgcgttcgcgtctgtcgaaaacagcggcgcgggcgcgttcccttcgcgatccttgcaaccgtccagcgcatccgcgcccggcggcaccttcgcaggatcgacgcggaaataacggaaggcgcagcgcgggcaatgaagcgcggcattgtatgcgtatgcggtaatcgtcgtcatgtcgttagctccctttcaatcttcggattcatcggccgcgcggccgggctcgccgtacacgctcgcgacaagcgcggcgcgcaattccagcggcgcacggttcgcgatcatctcgcgcagacgcgcgcgcatctttgctttgtcgttttcccattgctcgcgcgcttcgctgtagtcgctgaagtattccggccaataatcatcatccgcatagcgcgaaccgcgctcatcgaacgattcaaggtccgcgccttcgctttccagatgctcgccgagaaattcgcttagcacgtcgtcggccgcgtccatgcgttcgcggttgctcgcgtaatcgctccacgtcgtttcacctttcgcccaccatttttccggccaccattccgcgctgcgatcaaggaacgcgcggcgcgagcatgcgaagcctaccgcgtgcgcgtcgtattcctgatccgtaggcttgccggccttgtccagccagcaccagacaagcccggaagaatcggccgcatcctcgaccgcatcgcggcaccagtcgaaaaactgcaacgcataatccgcgcggcgcgagtctgcaaccgcgcgcgtcatgtcgtcggcgatttgctcacggtacacgctcagcggcgcatccgggcaaaggtacgcgaacaattcgcgcgcgtcgtcgccgtattccttttccagctcgcgcgcatagtcgcgggaatacagataagaaaaatcgacgttatccatgcaatcgttttccgcgtcctgcaacgtcgcatgatcgaatccgcgacccttgaaaaaatcggcgatgtcgcgcgacccttgccagaaagacgcggccagatagcgcgcagcgttgcgccgatactttgcgcggcgcgcttccgtgtcgcgcgttcgcttgtcgcgctgcgattggatgcgcgattccgtgcgcgtcagaatggcgggctttgcgttgtttgcgatgctgtacattttcagattctccgggcttatcacggatgggaagggttaagcgtggcgcaggattgcgaacgcgccgccagactgccacgcgctcgccgtgtaatcgaaggactcgccgttgtcgccgatgcagcgatagacgggcgcaaggtcgcgcaggtatcggccgtcgctgtgcggttccagctccaccagacggaaggccgggcgcgcgatgcaagcctgcaaaacgcgcaggtccgcatcgctgaattgctgcgcggcttccgtgcggcgcaccgtgccgcgcgacgtgtagacaaggcggcgcagccattccgcgcccttgcgcgcttgcgcatccgtgacgcgcggcgcatgcgtgctaatcatgttcaccagctcccacgcttccgcagcggtagcagacggcgacggttcgcgcttgaaatactcttcagcgttcacggcatcgcgcagcaacgcgcgcgccttgcggatgatggattccgccagctcgccggatgcgatgcgctgcgcggttgtctttgcccatttgctttgcatgttcattctccaatgtagtaaaaaacgcggccatcgtctgcgcggaaaaaacggccggcgacggttccggcttcgcttgcggtttcatactgcggccaccattcatccgtgaacggttccgcgccgccttcgatgtcggcatagctggaaaaatcggcctcgcgcatgtcgccggcgatgaattgcagcataagcgcggcgcattcttcatccgtatgcgcggccaattcttcagcgtcccacgcgccgaaatgcgaaaaatactcatcgaatgcggcgcggtcgaaatgctcgccgaaaagctcgcgcgcatcctcgcatgcggcttcccacgtaatgcggccggcatcgtttcccagctcagcaacggatgccgagtaatcgcgcggcgcgatactggcgacgattgcggttacgtcaagctcgcacatatcaaaaatcctcgaacaattcgcgcaggtcgcgcagcatgccatcgctgaaaagccgcgcgagcccgacggccgttaccttgcacgcgcgccacgtcttttccgcgctgcgcgaatccgtgtcatacccaaggtccgcgcaaaaatcctcgaaagactgcgcgccgcattccgcatcgcgcattagacaattcagcacgtccgccagctcaggcgagcccgtatgcgccgcgcccatgctgtaatccgttgtcatgctcgcgcggtcgcggcgcagcgtgacgcgccagtgtgacgcgctcgcgtcccatccttcgcgcggtccatccttgcgcgttgcgcgcatggtgacgcctagcgcgtctaggatgaattcgcggtcatcgctcagcggatcgaagcgcgaaccgtcgccgggcatctcttcatcgtatgcgggcgcgtagtggtattgcaggtcgcacaatgcgccatctttgcaaagggaatccgtgtaatcgttccacgattccgccagcatgggcgcgtcgtcttgcggaatgtctgcggccaattcttgccactgtgcgaaggcttgcgaaaggctaatgcgttgcatggtgaatctcccttgtctggtgaattgttaggcgatggacacaaccgcatgacgcggcagcgggaaaccgtgcggaatccctagcaggtcgcgcacgtatgcgcgcatcgcgtctttgctttccgcgtaggcgacgacgggaagcgtagcggacgaaacgaaaagataacggcgcatgattcgggctcccttagacgacggacacggcgacggccgcgaccgcgacaaaggcggcaacggcgacggagaaaagaaacggaaggcgcgcgataaggtcgcgcaacgtctggaccttgcgcgcggtttcgaccttgcgcgcagcctgcgcgccacgcgacgcggccagcgcggcatgggcggaaaattcggagcgttcgatgcgtgccatgtttgcgaccctttgcgatgccggcgacgttgccggtatgcgtaggctacacggttccgcgcgccgcgcaagtatttttttactgcgcgcagtagtccgtttactttgcattcaggaagcgcggaaggcggcaagcgcgcccggatgaagggaaccgcgcaacgcgcagcgcgcgcagcattgacgcgcccgcgtcgccggcatgcgggcgcacgacaaccgcgcgccgcgcgcgtcgagaaccgcgcgtgatgcgtgcgagcgagcgcgcgtcgtgcgcacatgcgcatgcccgcacgcacgtacatgcaagagagcaattccaaaaacgtccccgcttcggatacccagcccgttccaaaattcggcccgcttcgcaaagccagccggttccgtttgcgctctcgcttcgccgacctagccggttccgaaattgcgcccgcttcggcaacccagccggaccttcatgcggcatcggcccggcgcgcgagctggtcacgaccgagaacgcccgggttgacacgaccccgggtgcgcgcagtagtatgtttcttgtccgcttacttccccggaacaggaggcatcacccaatggcatccgccagcacgaacagcagcgccaacactgcgcagaagacccgcaagaagccggggtcgaaggccgcactgaagaagcacatcgccaacccgcgcgtgcgcatcgtcgagaagccccggctcatcttcctgccgggctcgctcaacgaccagctcagcaagctcgacatcggcgagtcgcacgcgcgctgccagcgcatcccgctcgacaacggcaacattgccgcgatcaacaacgaggcacagaaatacttcaagcagcagaactcgatcctgagcggcggcatcgccaaggtgcgcggcgtggccgagcacaagtcgaagcggttcaagatggaacgcggcacctacatgagcgccagcaacgacgccatgtttgcgttcctcaccgtcacccggatggagtgaccgcagccatgcgccacacgcaccgcgaaatcgcagaggcgaaaatgttgggccgtaggcttgcggctcttcggaacgctccggtaccccctttgtctcgcctgcgcagcgctaccaccctgctgacccgcgcagtaattctcgccctgcggatgaaggtgcgcgctgcatggctccaactgttcgaccgcaccgtctgcccgaagtgcgaaggccacaagcaccagctcacgcacatcatccatgacgagtacgaaatgcggccgtgccgactgtgcaacgcacgcggctggatcgactggcgcgagcgcgagtcggtgaagtggggcgcagcagcgaagcgctaccgcctcaatgcaggcttctcgctcgcgaaggcgtactacctgtgcggtatgacgcctgaccagatcaccatgcacgaggacggactcgtgccgctcgacgattggccctcgtcgttgcgtgacattgcagaccttcaactcgaccgcgaggccgccggtcacgtcagcaccacctaactcaaccgaggaaacgccgaaatgtctcatcacatcgaaaagcagttccgcaataccgctaccacccccatgatcgtgtccgtcgctgcgtgcgttgacgagcagggcatcgtgcgcgaaatccatgcgaccggcggcgtcgtcggcaccagcgatgaccagcgcgcggaagcgcagcgcatgcacaagtggattcgcgagaccttcatcggtcagcacagcttcttcttcaacgcgcacgacggcaccgtgttctcggccgagaagccgcaccgccgcgagtacccgttctcgaagcagccggaaatccacatcatcaacaccatcgacttcagcccggacgctatcgctgatgcgatgaagggcacgccgagcctcatcgagcgcatcatgcgccgcgacttcagcaagacgcagacgaccaagggcgcagcgagcgaccgcaaggaagcgcgtgcggtgacggtcggccacccgggctacgagttcgcgccgaaggtcggcacctactggcaggaccgcaaccgcccggcacgcttcttcatggtcgtcagcacgcacgagtgcgagggccacagccacgtccgcatgctgcgcgtcgacaacggtcgcggcggcgagtacgaatggacgttcaccacggcgagcgcatggaacgacctgttcgcaccgacgactgccggcgctgtcccgggcaacccgtacgcgcagatggccgccgagctgcatgacgtgtcgttcaagcctgcacgctcgcgccgcgtcggcatgccgcccgaactcggcatgggctacggcctcatcgagtcgctgttccgcgacttcatcgagaacgtggagttcgacggcaccgagcagccgccggccgctggcgagcgctacttctccgtcatctcgggcggcacctacaccgtgatcgacgcgcgccgcaagccggacagcacggactactacgtgacgatggagcgcgacggcgacggccaccgcaccaagtttacctaccgcgaccatgcgacgtggctcgcgacgtggcggccggctgacgatgaaggcgaagcgcgcgaggtcgtcgaggtcgaactgcggctggacacgaaggacgccagcgaggcgctgcgcaacgtcggcgagcaggcgcacgctgcggctgaggcgatgatggacttccgcgaagccgacgccgagcggcagctcaacgtcatttaccgcgagctggatcgcaaggtgcccggctggcgcaacatgggcgcgcactacgagaacatcgacgacgtgggcctcgcgctgcgtgctatccgctcgatcaacaagcacatgcgcaactaccagcagatcgccgagaccagcaccaacgaggtcgccaagctgtcggacaagaaccgcgagctgtcgtccttgctgggcgtgcgcacgcgcgaggtcgacaagctgaagcaggagcgcggcggtgcgtgggacgcagcgcgtgtgcgccgagagcaggacaccatgcgcgagatgatgcgccactacgccctgctgttcgcccggcaccacggcaaggccgcgctgaaggaagcgctcgccacgctcgatgccgacacgctgctgggcctgccgcacgagcacttcatgctgctcgtgaccaagtgcgaggcccactccgctcgcgaagaggtctgagccatgtccaagaccatctcgcaggccgacgcgcgtcgctacaagcggcgcgtcgaagagctggaaagcgtgctcgatgcacagcgcgcgagctggactcacgagtacccgggcggcgtgcatatcggcaccgagaccggcgtcagcaccgacacgacgacctcgatcaagaccgcgcgcaagctcggccacgcggtcgtcgccgtgcagcgcatgaacggcgaagtgctgttctacgcgctgccgctgccgaagggcgagtgagcatgaaggtgcagtacgaagaaatcggactgccgcaggacacgggcgtctacgcttgccgcgtagacgacccgcacggtcgcgggctcgtcgtcgatgtcttcctcatgtggttcggggatcgctggtgctacctcaacagcgaccaatacttcaggggagaagtccacggctggatcggcccgctgccgcgcctgcggccactacgcgcgcacgttgaggcaccgcatgacgaagattgaacatctcgaagtgctcgacgatccgacagtcgaagggctgtacgccgtcgagttgacgcgcaacccgacaatcgtccacgacccgcgcatgtacgcggtgatgcgctgggcgaacggccattggtgggagcgcaggccaagcctgaagacgccgttcgtgcccttcaccggcatggtgctcggctgggccgggccgatgcgctacgaggacatcgaagtgctcgaagacccgccggagttcggcttctacgccatctggcaccacccgtacccgcacgcgctgccgcagcacgcggagatggaaattgccgtgtggttgccggagtacggccagatgcgcgggcgctggtgggacaactacggatggaaccggcaccacggctccgtcgatggctggatcggcccgctgccgatgctctcgcgcaagcccatgtggctgctgaagcgcgaggaaggacaggacatcgggctatgagtttccgtccgtcgactggccgaaagatcacggtcaagaagaacccgaagacggtgcgcgacatcatgcgccgccaccttcgcgaagaaggcaagcgtatcgtcgacctgtgcccggtgtgggacatgattccgcaaagtgcataccgccgtttctacgacaagcgcccgatgacgccgcagatgatcgacagcttcatcgagtacctgcgcctcgatgtcgacgacgcgagcgagctgcggttgttcgctgcaatcgaggccggctggcagctcgaccacctgaaggaaaaagccgcatgaagttcaagcgcatccaaccctaccgcgacgtgttcatcgccgagctgcacagcgaccaagtgcgcagcgacggcggcccgctggtcgtgctcgacggcggcattggcgtccacgttgcctactacatcgtcgacgacttcggcgaagtgctgcacccgatccaagcctacttcacgtctcccgtcatcgcgtgcgctgcggcggacatcctcatcgacaccccgaaaaagttcgacgcaaaggtttcggccttgctgcgcgttgaacgtgattttgccaaggacttttgaccatgagcgacatgcagaccacgaacgacctcatcgcgatcatccgtcagcgcgcggacgccggcctgaagaagtacggcgtgacgctggatcgcaaagaccttacgaccgcgcagtggttgcgccatctgctcgaagagctgtgcgacggtgcgggctacgtgctcgccgccgagcgcaaagcggtcgagaccgagaccgcgatccgcgccgcgatccaactgctcgtgctcggcgacacgcagggcgcggccgacgtgctcgcttcgtgcctgcctgacggagacgccgatggcgagcctgtcgtgctcgtgcgtgacgcgggcggcgcgtgagcgagcgcagcttcatcgccatgagagccgcgcaacctgagcccaagcaggcgtgcttgtacgcctcagcgtcccttgacccgtacttcaacgagagttttcgcatgccactccctgacgccagcaagcgccgctacgcacacatggccgcgtaccggggctacaccatcgccacgtacaaagacccgctcgacgagcccgtgtatctcatcggcacgacgcccgtattcgcggtgtacttcgcgctcgatgagctgggcgagccgatcacgccggtcgatacgtgcttttggtcgccgttcctcgcgatggcgatgatcgaccaatacgtcgcgctgaccgagcacgagcgcaagcagtggtggaaggcgcagggcgcgtggccgatgatccaccagaactacagcgcgcagcaccagctcccgatgctgctcgacacgctgcgcaacgtcgccgccgaatgcgctgaccctgacctcgacctcatgtacggcgatgcatcggagttcggcaaagcgatggcggcaaagatcaagaagggactcgaaacactccaccacgttcctgcgccgaaggaaggcgaagagcgtccacacgcgaggtctgtatgagctggttcgattggttgctgctggtgatcggccccaacgtcatcgctggcattgcgatgctgcggcagcgcgcgcggcacgcgaagtaccgcgaggctatccatgcgctgctcgccgatgagggctacgccgagggcgaaccgcaggccatcatcgacgaggcgctgcgcatgaccgcgcatctcggcatgaaggagccgagcgctcgcgacttcgcgcatgcgcttgtgcagcaggaagcgtttcgcaaggcagtcgctcacgagatgctgcacgacgtttacatccagacccacgggcgggcgctatgagcaggcagaaattcgacgacgaggattacgcagtgaaagaggttgcgcgcgttcggctgtacgccatcgacggcgacgaaatgacgttcgagcagatcaagcgacactgcccgcacgtcagcgagaagatgctgcgcgacaggctcttccggggcgagcgcaagatggcccggctgagccggccgccggacacgaggaagggtgttgacaagccgaaaagctggcgctagagtggccccgcagtaacgaatttacttcgtccccctacggggtaaatcacgaactgcacggggtcgccgaggcgatacccccggtcaactggatggcgcactccccagcgcttgaagggtcaacccggcggcttgcggcacgatacgccgctcttcatctcacgccgagagaaccaatgaaaatcgacttcgccgaactgccgaatatccgcgacttgctcgacaagctcatcctcgaccgccacaacctcgccatgctcacgagcggcgacaccgagaacttccgcgtcgtctccgaaggcggcatgcacgccggggagctgacgaaggccgagttgctgaccgtcttccagaaccgtgtcgacaccggactgaagacgctcaacacgcgctactacatcgagttcaagaacctcgacggctcgcagccgttgccgctcgttcgtccgcaggtcgacgtgaccaacgcggacggcccggccaccgccgacgcggcggtcgacgcatgaactaccccatcatcccgaggatgttccccgccatgatcgctcccaaggtctcccgtcgcttctacgacgtgctctcgatgatcggcctatggtcggtcttcgtcggcgcgttcaagctgtatgcgcgtctcgtctcgccgtccaaggtcatcatgctcgacggcatcgacggcggcccgcgtcgcccgtacctgacgcgctggcacataatcccgcgcaaccgctggttcaacctgtacctgcacaagttcgtccacggtgacgacgaccgcgcactgcacgaccatccgtgggtcagcgcctcgctcatcctcgacggccgctacatcgagcacacgagcgagtggtgctacgagcacgccatcgacgagagcgccgccggcatggacgcacacgtctcgtacatgcaccgactgttcaccccgggcgacggccgcacgtacgtcgaaggcagcgtcgttcgcaacaagggcaagttcccgggccagcacaagttcgactacacgcagcagttccgcacgggcgacttccgccgcctgagtgccgaccacatgcacctgctcgaactgttcggcaacaacgacgagccgtgctggacgctcttcatgaccggctccatcgtgcgccgctggggcttcgcgtgcggcggctcggaaggctggcgtgacttcagccagtacaccgccgcgcacccgacccgcgcgaacgccaccgtgggctgcgagtgatgagccgccgcgagaagatcgtctacgtcgtgctgctgctggcctgcatggcgggcctgtacatcacgcagccgtccgagtgtcggacgttccgcaccgaagtccccgcgtactgcgtggactgaaccgaatcccgcaagggaaccccgctcgcattccgcgagttgtcgacaacaacgctaggagaaaccagatgtccgagaacgccgaagccaccgaggcgaaggtcgcgaagaagcgccccgccaagaaggccgccaagaagactgcacgcaaggccgccgcgaagaaggctccggccaagcgcgtcgcgaagaaggccgaagccgctgcgcccgccaagcgcggtcgcccggccggcaagaagactgccgcccgcaaggtcggcgtgcgtcgtggcaagaagggcgcgaagcagttcgcgtacctgctgctgaccgcgcaggaagacggttcgcagaaggccagcaccatgaacggcccgttcgcgaccgagggcaatgcgctcgacgacgcgagcatcatggccgacgacaacacgaccatcgtgctgttccgcgagaccaagcgcggccgggtgcagaagcagaccaagttcgtcgccggccgctgagcccgtggcgttgacgtagtacatcgaagcggccctgtcgacatcggccgggccgctttttcatttccaaggagcacacgatgaacctgttgaagcgcattttccgttcgtacgattccgagaaggcgaagaccctgagcccgtggcgcaagcgcatgctcgccgtcgacgagaactacgccttcctgctgcaagcccgcgacaacgcgaacgagcagcagaagaacaagcgccaagtgcgcacgtcgaagggcggcattgccggcgtcctcgcgatccgcgaccacggctcgccgcaggagaagttgcgcaaggcgttcggcggcaagaccatgcgccgcatcctgaaggccgagcgtcgcgccgcgcgcgagaaccccgaggcgctggtcgtccacgccatcgccgacgacggtgcgcgcaaccagctcgtgcgcggtgtcgacttcgcgatgatcccggccgcgcacggcggccccacgctcgtgctgcacgacatggcgacgaagttcgacgccagctacagcaacgacttcgccgaggcgctggccgccgggggccgcgcatgagcatcctgtccctcgataccgcacgcgagtcgcgtgctgcgcgcgtcgagcccacgcgcgtcttcgccgaggcgtacaacgccttcaccgtcacgaccgccaagtacccgaccgacatcgtgcagctcgccggcaacgtcagcgccggcatgctgtacaccggcatcggtctgtcgaacgaagtcggcgagctggccgagctgttcgaccaagaagccatccgcgaagagttccgcgtcgagcgctaccggaaggcgtggcacgagctgggcgacgtgcagtggtacgccgcgcgcctgtgcgccgagaccccggagctgccgcgcttcgacgtgctggtgcaggaaggcatgcagcgcctcgccgacgccgagtaccgcgaggtccgtatcagcggctacgacctgcaatcggccctgtgtgcgcacgccggccgcgtgctgggcgtcatcaagaagatgatgcgcgatggtgcgacgtggagcgccgagaagcgtgcggagaagatcgccgagttgcgcggtgcgctcgctgcggtgatcgccgtgtcggtcgagtacgccgagcgcacggggccgctggtgggctgcgagggcggctacgagaagctgctgttcgacaaccgcgaaaagctcaacggacgcaaggaacgcggcacgttgcagggcgacggagacgtgcgatgaatgcaaccgttcgaggcttcttcgtcggtgggccggctgacggcatggtgcgcgagttcgactcgcgcccaccggatcgcatgcaggcgacgccagaaggtcaaggccagctcatcccgggcgcggctccgaccatctacacccgcaacgacctgaccggcggcacagtgatctacgtgcccgccggcacgctgctgcacgatgcgttcgtccgcgtgctcgacagctacgccgaggcccggcagctcgacaagctcagcgacgagcacaaccgcgtaggaggctgacgtggcatacgagcacctgacgatcatgctgagcctgccgcgcagccgcagcgcatggatggccgagttccttcggccgttgtgcgtgtcgtcgatgcacaacccgcttcagcagtgcgcaagcatcgctgagctgggccagaagatcgacaagcagccgtccggtcgcgtgttcgtgtcggacgtggccggactgttcttcttcgaccaactgctcgtccggttcccgggcgcgcagtacctcgtcgtgcatcgtgcggcgagcgaagtcgagcactccatgcgcaagcagggcatccagccgccgctcaacgtgcgcaaggccgagcggcaactgctcgacatcgcggcgcacatccggccgcacccgtggtcgatgaccggcacgttcttcgagctgcactcgcctcagattctcatggcgattgcgaagttcgcgaccgggcacgcagtagagccgcgctacctgcaccagatgatgaatcgcaacgtgcaggttcccatccaagaccagatcactcgcaccgacatgcagaagcagcgccagctcttcagcaaggcgaagatcgacttccactaggggacaccatgaagaccatcgacagcttcaacggcccgtaccgcttcctctcgaatttctggtcatgctgcatcgccttcgaggggcactcgtaccgcaccgtggagcacgccttccaagcagccaagacgctcgacgaggacgagcgccgtcgcattcgcaacgagccgagcgccgctggcgcgaagcagcgcggcaagcacgcaacgctgcgcgaagattgggagcagatcaaggtcggcgtcatgcgcgacctgctgcgccagaagttcggcaccgacccgctgcggtcgcgcctgctgaagaccgggaagtcgaagctcgtcgaagggaattggtggggcgaccgtttttggggcgtatgcgaaggcaagggcgagaatcatctcggcctgttgctcatggaaatccgcgaagaacttcgcgcacagaaggaatcgaacaatggataagcaacacatgctcgcgctattcgtgctggcaggcatcatggtcaagcacgcggaagaacttccgaacggctactggccgaacgtgcctcactacgacgacattcgtcgaaacagcccgtggtggctcgccatgaccgagtttggcccggtcaagatcggctggcgtaagcgcgtcatctcgattgattggaccgcgacggaagtgcgggccgtcatcaccgaagacgacgtgaccaagggcgaggaatacgtgcatgcgtggacttacgcgaaggccgtcgagtacctgaccaacttcgctcaggaggcccgccgtggctaagcgaattctcatctgcggtctgccgggcagcggcaagaccaccctcggcgcagcgctcgcgcgcgtgttgccggcaacgcacatcgacggcgacaacgctcgcagcacgtacagcgattgggacttcagcgacgaagggcgcgtgcgtcaggcgcagcgcatgcgcgagctggctgacaccaacggcggcctcgtcgtcgcgtcgtttgtgtgcccgaccgaagagacgcgcgaggcgttcgcacctgacctcatcgttttcatggacacggtgcagaagagccgctacccggacaccgacgaaatgttcgagcgcccgcagcaggtcgcggtgcaagtcacggccgaagtgatgcagcccacgctcgaacgcattgccgcgtgcctgcgctacctgacgccgcagggcacgatgatcggccgctaccagccgtggcatgcgggccacaccgcgctgttccgcgagacgctggcgcgcagcggctacgtcggcatcggcgtgcgcactgtgcaaccgagcccggacaacccgtacacctacccgcagatcgagcagcgcatccaccacgcgctgcacgcgcacgccggcagctaccacatctacccggtgcccgacgtgcgcggcgtgtactacggtcgcgacgtgggctatgcggtcgaacgcatcgagctgtcgcctgaaatcgaatccatccgcgccactgacatccgggccgccgaacagcccgccaaccgctaacaggagccgagtgccatgagtctcgaacgctacaaagaaatcaccttcaagacgaagaccctgcaacagatcgacaggatcaacgcgatcatcgaagaatatcttgatgcggggtacacgctgaccgtgcgccagctctactaccagctcgtcgcgcgcgacatcattccgaacaacgagaagtcgtacaagcagaccacgagcatcgtcaacgacgcgcgcatcgccggcctgattgattgggacgccatcgaagaccgcacgcgctcgttcgagcagcgcagccgttggtcgcgcccgcaggacattctcacggcgtcggcacggcagtaccacaccgacccgtgggcgacgcaggagaagcgcctgttcctcgtcgtcgagaaggaagcgctggtcggcgtcttcagccgcgtgtgccacgagttcgacgtgccgctgctcgcggcgcgcggctacccgagcgcatcggtcgtgcgcgatttcgcgaagcgggaaatcgaagagagcgacggcaaggatgtcgtgatcctgcacttcggagaccatgacccgagcggcatcgacatgacgcgcgacctcgaagagcgcttcgagctgttcggctggaacggcgagttcacgctgaagcgcatggcgttgaacctcgaccagatcgaagagctgaagccgccgccgaacccggccaagacgaccgacgcgcgcttcgtgaaataccgccagcgcttcggcgacaagagctgggagctggacgcgctgccgccgaccgtgctgagcgaaatggcgcgcaatgaaatcctcacgcacgtcgacacgaaggcgtgggacaagtggagtgccggcgtcgagaaggcgcgcaagaagatgatgaagctggtcgagacgtggaaggactgacgaaggtgttgacaccctgagcgcatcgcattagggtcgactcatcgacgcgacattgcccttccagccggcgcagcgctccacgagcggacaccggaatcagcagaaccgccgcctcgatacccactgctccggcgcgacgccgcagcgacccgagaccccgccccggcaacgtggcggggtttctttttgggtcttgacgaacttggtcatgacgcacttggtcttgacgcaaaaagaaaccccggatggttagtccggggttcctcgttccctgcggtgcggagcgccgattcaccgcgccgctgtccctctgccgagtgccgatgcaacgcgaagtgccaccagcgggatcaaccgtaatgcagcgcctcgggcctgtcaactactgccggatgagccctttcgcttcgaggtcgtcgaggcatccatgctcgacgcggcggtacccctcgctcactcgcaccacgcccagaacgtcgatgatccagttcaccgcacgctcgctgagccgcgcttcgccttcggtcttgcccgggcgcggtgggttccactcgatccactcgtcggccttcggctcgcgcggcactgccggcgacgcaggctgcttgcagttaacgaggggcgcttcttgcttcaactgcggcagctcgcgctttgccgatccggtcttgcacccgctcgtcgagagggtgaacacaagaaccaacagcaacaggcgcagtgacgggcggctttttgtacacatcatggatggtctccttcgagtcgttcttcgcttcttcggcatcggctgcgaccttcgctgcttcggcgtcggcggccttgccgatttccgaagcggtctggttgtcggcgatgttcttttcaccttgcgcgacgttggccgcgttcgtatcggtggcgcggccagcttggcaagacgcgacgccctcgttgtagtagtgcgtcgagaacgcataccagccgagcgccatgcctatcgcgatgctgccgccaagcagcacaccgcgacccatcgccgttccgaacagccacgcgattgctttcgtccacatgctcatctccttacggggtttcgacgaggatcgcttcggcctcgcggcgcgcagacaatccgttctcattgaccgtgccgcgccacaaccgcttcatgctgcgaatctccgaagcgatgcaggcatagtcctgcttcggcacgcagttgtcgcggatgttgcgcatctcccgtcgcgagtcgccggtcatcgccgcgccacggttgtacaccagcgagattagcgccccgcatgcgttcggccgcagctccgtgaagccgttgcggaacgcgcgctcggtgcggcgctcgtactcgacgaggctgcgttcctcgaacacacggctggcgtggtcgaagccagtcgggatgtcgcggaagcgcggcagcgccaccttggccggctggcctacgatgccggcggtctggcccagccggtcgacctgcccgtggtcgtgccagtcgtcgacgatcaccgcccggggctggtggccgccgtcgtacccgatcccccacgtcaccccggacgccccgcccggccagatcggcagttcgagccgcttccggtagaacgccgggctggtcacttcccagcgtagcgtcagggccgccgcagcgcgccggcaagccgcgtcccgggccggcggcgggggtagtagcggggtaaggtccgcgagcgccgcctgcgcagccagaagcggctccgtgacggtctccgaaaccgcctgctcggcccggggcaggggttgggccgagacgacctgctcggcgaccggctccggcgtggccgctggcaggctctccacggccggcgggagcacggtctggtcgaccgggggtaccgctgccggccgggcgcacgcgcccagcaggagggccgcagcgaggactacgacccgggcgctcatcgggtgtaccagaaggtcgcgaacgccagcgccagcatccactcgatgcggtcggtccagacgatccagtgcgcgtcgcggttgccttgcttgcgcaggtcgaacagttcgagttcggtgcggtcgtgcaggtcgaaccagcaccacttcttcatccaccatgtggtgaagatgatgagcgtgatgcgcaccgcgttgagcgcgtagccgaagatgtcgccgaagccttcgacgccgatgcgagagtcgaccgacttcagcacgatgtagctgccgatgaggaagaccagcatgaccgggagctggaagaggatgatctggttgcggcgccagaactcccacgcgcgacgacggaacggcatcttactttccgggttggccgggctgctgttgttggtgtccattttctttcctctgtgattgcggaacgtagggctcttcggggatgcggcccccgcgagcgagatagagcttgatgtcggccagctctttgccgtgttctacacccatcgcgtcgatgagctgccggttgtaggccgacgacttctcgactcgatccgtgtcctctttgttgtcgttgaagcggtagttgatgttccacaggaagccgccaacgatcacgcccgccaatgcgccgattgcggaaccgaacccgacgaagcggatgacggtctcgcgcacgctgcggatttccttctccaagtccttcttgacgttttcgttctcggcttcgtgctcgcgccgccattgatcgcggttgttcgagtagtcgcgccaccgttgttcctgcttggcctcgaactcatcgaaccacgactccaacctcgcaccaagttccgacactgatttctccaccttgtcgattgctaccttgttcgagtcgtgcgcgccttgcagaccgcgtagctccgacacgttcgtcgagcagccgcgcacttcgacctgtacggccgcgagcgtggcgcttacgttctccatgccggagctgacgcgctgcgtgagcagacgcatatcgccttcgatgcgttcgagccgaatggcctgttgcgcggcgtccagaagtccccctgctttgtccgtcactcttcggttcctattctgctcgttgttgttcgggctcacggcacttctccttacggcccgggctcgggtgtcagtcgatcccaaatgaccgcgttctgcaacggtgcgccttccgggtcgaacgcgatggcgtagtacgcctgaccgcccggcatgaggttatcgaattgcacgtagccgtcgacatcggagagctggatgtctacgagcgtatgcaagcgcctgaagaacagcacgacgcgcgcgtactgtaccggcgcatccggcaacaccccgtcaggatcgcgctgcatcactcggccgcgcagcttgtaggttgggagctgcgtggtcgacccgctcggcccccaccacggcggcacgccgcgcgtgaccttgaccgtctgcactttcttcgtttccataggcgggaacgaatagaagatgctccggcggatcgccgaacgattgcgcgcacgatcccagccgaccagcgacttagctacgaacgcggaaacccggccgtacgagacaaccggctcggtgatttccagcgagacgtttcgcagcgaacctttgtagtcgtacggataccgctggtagacgcgcgttccgatacctatgatcggcgtaaccgcgtagtctcggccgtcacttcctgtcgcaagcgtcacgccgtcaagaacaattctgacggctccgctctcgcgaataatttcgacggtgtgccagttgccgtccgcaacatccacagtgccgccgacaagattgatgccgccgtagctcgggttgtacacgctccacgcaagcaccccgtcttgcgtgtagacctgccaagtccatgcgctgatagacgtgttgatctggtcgaggatgatcctgtagccgcccttgtccgctgccgccatgcgcatgtcgaaggcaatgcggaaattactgatagcgccgatcttcacccggctatcgacaggcgcgctcacgtagtcgtcgctgccgtctagcagcagcgcgttggattgaatctgcgcgttgccgttcaccgaccacgagaagtttcccgtggtgtcggtaatcgtcgtggagccatccggccccgacatcggcaggttgaagatgagcgccatcgcgcgttacctatcccaagtgtcggaaatctcgaagaccgcagtgcattggtagtgcctgcgcgccatgaacgtcttgcccgccagctcgccttgaccgttgaaggtctgcccttggctgaagatgttctcgttgtgacacggcacccacaggccgggcatgagcccgcgcacgttgtacggcgaaacctgcggctcatgcacccacaccggggacaagtacaggccgccgtccgggccgtgcgggtaggacaaattgccgacgccccaagtgttgctgcccttggtcatgtcgttgtgccagccgaggtaaatcgggccgccgagattcgtgtaggagcgcgcggccagcatcacgtagcggctcgaacccatcgtgctgctgataccgacgccgtagaacggatagccttcagacgtattcgggctgctgtcgttccacgacccgagcaagatggtgtgcgtcgtgtcgcccggcttgaacgggatgatgtcgccgaacgcatagcactcgttgtagtagtaaccgctgtcgccgttctccgggtaggtgttcaccatgaagtagaacagcatctcgtccgcgatgatgcgccacgggcgcggattggcgaccgaaccgctgctgtagtgcgtgaaccacggcaggccattcgccttctgcgtcggcgtcgggaacgaagtcggcgtgccggtgttgacatcgctcattgcttcgtacgctttcatgaacgctgcgcggtagctggtcgcagtgctggtgtcgtcgatgcgcaggaacatgccgttcgatcctgcgccttgctggaacgccgcgacgttcgtgccggtaaacggcttcgtccagcctgcgccggctttcgagccgtagccggtgacgaggcacttttcgagcacgttgatgaggtcgcccggcgtgttgccgcgcagaaccggagcgccagcgtcggaagaagagtagatgcgaacagtcatttcaatacctcacattgtcaggattagcatgtaggtggatttgcgtagctcgtttccgccgccttcatcatctgcaccgaatatccattcgatgttcggggtcaacgggggcgtgtagtcgttgcccttgaagacccacacgatgttcggcgacaacggcgggatgtagtcgtctgccatcgttagattccatccacgattgcttgcacgtcgtagaagcccgcgtcgtcgtcgtagacgaaaccgagcctgtcggacttgccggcagtcgttgtcgggttgtagatcgggatgaggttgttgaagcgcacgttactgccgaacgaaacgccgtgaccgccgacgccgccttgcttcagcagcagcacgcagccctgaccgtcaagcgcacccgtcatgttgacgagcgtgtcggcggtcagcgtcacgcggatttcgtcgtaggagttccagtcgcacacgatggagccgctgtcggtattcgtgatgcgctggatacgacgctgcgacggaatgccgggcgggccttggtcgccttgatcgcccttctcgcctttcagcgatgcgagccattcggcctgcgtgccggcgaacccgttggcgacggcgacctgatatgcactcaacccttgcgggccttgcgcgccattcgcaccagccgggccgcgcagtgattcgagcgagaccagattgatccagtcggcgtcgcccacgtagcgccagcggatgtaaccgccgcccgtgccgatttcgatgagccggccctcgaagaacgacagcgagttccacggggtcgcgccgtcgccgatcttgaacttggtctcgtccgaagtagcgccgagctgcacgccaatctcgccggccgcgaggatcggattcttggcagaccaattcgccgcagtgtcgcggcgctgccacatgcgttgtgcaacgactacctgtgccattacgcgccacccccgtccagaacgtactcgggttcgtcgacgatgatttcgttggcggtagccccggcggccggagtatagctgaagtagccgaccagcttcgtccacgacacatagccgtcccgaaccgcctcgatttcaacgcgcatatcgcccgacaccgcgaagcgcatggtgccggtcgatgctgcgctcgacacgtccagcgcagacgccagcagcgcgttcgagctggtgtagacccggatgttgtaggttgtaccttcctcgggcgtacggctggtatcggcctgcgatgcaatgctgtcgtcgagacgattgcggtgcgcccacgagaacatcatgtcggccgtgtatgcagcacccgagcccacgaccgcgccgttgatgcgcaagcggcccggcggcagcggacgcagcgcacgagcattggtcgtgaccgacatcgccgcagcgttgtccagcggcaccgtgtcgatgatgctcttcggcgtcagcttcgtgttgagcgtcaggtcgccgccgtagccgtcttcgttggtcgtgcccgcgccttccgacatgaagtagacgcgcgaaccggaaccgtgatcctgcggcatggtgtcgagcacgccgcgatacacgcctgtgatcgtgtaagtgccgttgccgttgtttgtgattccctgccatgccatgagttcgttgccgaccagcagcaggttttcgcccgactcgcgcgagcccgcagtgcccgcttcgatgtcagccactccgacgaccgacgtgacggtgaagcccgcagcatcgacttccggcccggtgcgcgacaaacccgacaccagcacgcccgaaggcgtgagcgcgtcgatggcgttcgtctgctggaagttcgtgccgccgctggtgtcggtccacacgtcgtagccgatcacgccgttgctgttcggcacacccatcgtgatgacgtagcgccgcgacatatcctcggcaccgaatgccggcgcttcgatgatgcgctgctgcgtgaacggcacgaccgcgccaaccggcggttgccaatcgctcgggtccggcggaacgtaggccacggcattgaccgcgaagatgtcttccatcgccgtgatcttgatggccgggtcgtccagcgtgccgtagttgatttcgatgacgcgcatgagcacgttcgccagtccacggttcggcttgcggagccagaacgcagaaccgggacggagctggtagccgatgcggttgagcgacatcttcgccgacaccaacggcgacgccttcatcttcgacacgcgagcagcggtgttcatcgcggcggtcgagttgctgaagccgaggtagctgaattcttccgagtcgatcatgcccccgcgcacgtcgatattcgcgaggtcttggtattggaccggcgtcgtctcgaacgtggtgcggtcggtgtactgcacgatgatcgtgttcttcgtcatctcccacgacgaacgcgagaactcgaacgtatccggcaggatgttcgagtcgtcgacaatcagcagctcgtcttgctcttcgtcgggaatctcgcgggccagcgtcatcgtgtacaggcccgtcaccgggtcggcgtacaccacgccgtcagcgtgccgcagcatttccgccacgaggtcgcggccgagcatggcggtctgcaccagcatcgagatgccgatgctctcgtcggccagcgtgttgccgcaggcgatgaacgaatccacgtcgatcttgtcttcggggattttcatgccccacatattgttggtcatgacctcgtacacggcgcacgcgatgttcgagtcgccgttgacgttgtgccggccgccagtcaagccgagctggttcgggcagcggcgcgtgatgatcgagatgggcggcggcgtgtcggtgttgccgaggtagcacttctccatgaccatgtgcagcagcggacggaacgcggtcatctccggctcgtcccactgctcgctcaggtacatattcggcggctgctcgaaggtgccgcgatacagcttgcagttgcccttgacgccgttcggcgggtcgtcgttgctgataatcgtcggcgcgttgatcgtgaaggcgcacacgtctcccgtgaacgtcttgttgttgatcggcgcaaccttgtcgtcgatacgcagttcgatgaactcgtcgcacggcccgtaggcgaacacgagctgcacgccgaggtagtagttgtacccggtgacgatgcgcttcgacgagaaccagccggtcttgaccttcttcttcagcgtgatgatcgtcaggtcgccgaaccacacgacgttcggaccttgcatcttgcaggtgccgaagaagatcggaatgacgcgcgaggcatccgcagtcgggaacgagaagtcgccgacagcagaaggcttcgggtcgttgaatttcggcttcggccgaagcagctcgccaactacagccatgacgagcgcaactacgatggctacccaaaccattaggtgatcccctgcgagaagacgttgtaggccgggaagtgatcgaacccgacgtagttgagcttgttgttgaacttgtccgcgcacacttccttcgtgcgtgcgcagccggcgtaaacctcgatgatctggctcccgttaatttcgaggaacggatacaccagcgtgatcgtgccggcggcggcgtcgtgcgcaacgatgaagcgttgttcgccggttgccgggttgtaggcgaagccgttggtgtaccagccggtcggcttggccgagaactcaggcgagcccagcaccgcaccgttgacggtcgtgaccagcgcatcgttcttccacaactgcttgtcgacgccgcagccgacttggtacaagccccaaatgcagccgctcttgaacaccgcccacgggaccgtctgcgagaggttgtcgatgatctgcgagcattcgagcgtggcctcagcgcccttctggttgaagctggtgatgtggccggtgaatgcctgcacgatttccgcagcagggtcgttgcgctggtaggcgtagatcgtcagcttgatcggccgcgccggcaggtacggcacatgcgccagtgccaccgggttgtcgaacggcatcgtgacttgcaggttctcgatattcgcgtcgccggccgtctgcttcagctcgccgcgcttgatcgactcgggcttgtacacgatggggccgagcaccttttcgcgcgcatcggtcgtgtaggcccagcgatagcggccatcgtcgctctcgaacaagtacagctccacgcgggagctgagttccttgtcgctttcgtattgcaagaggctcatgtcaatcctcggtcgtcttcgcgaccatgatggcttctaccgtagccttcgagtcggtcaggtggcggatggtggtggacggcgactcgaagcggtacagcgtgaggaagctgatacgcgccacgtcgtcgacatcgagcgagacgcccagcgacgaatcgagttgcagccgggtgaagttgtcgaagtcgctggtgccgagaatgcggcggcagaaatacgtgccgtcgtgcagctcgatgatgatgtcgcggcgtgccgggtgtgcgccggccagcgcgccgtattcgttgttctcgaccacgaggatgtcttcggtgtcgaggatcggcgcggccatgttgaagtcgaccgtgccgctcggcatgaacaccgaacgcgcgacgccctgccggcggccgaggaactgccggaacgagaagatgtcgccacggttgaacagcgtccagttgtgccggcgcgacatcttcgagaagcctgccgacgagaacgcgacgaacttgccggtgttcgagtcgacgcgcttgacatccgacgtgaaggtgaagggcatagccgactgccagttgatgcgaccgagaaacagctccttgccccggtaggtcaacggcgcgatgttgagcgcgacgttgcccggggtcacgctcggttcgcagtcgaacgcgaccggcattcggcccaccgtcgacgtttcgcgcgatccgctcatcgcatcgttcatgagcccgacgaagcacggatagatgcgcgagccttccggccagtcgtattgcaacccggtcgtgaccgtaatgccgtcgacgccgaccgtctgcacttcgcggatttcgttcgtctcgtcgtcgaggtacagcgcgaccagcgagccgggttcgagcgacaggccgaaggtgtcgaacggaatcgtcgtagcgccggccgccacgtctgcgtcgatgcgctcttcctcgccccaatgcggcacgccgaagaagcgcgactgccacgcgaacagcaggttctcgcatcgctgcgcctgcaacgccgtgcgcaggttgatgttgtattcgagcgtgcggcgcggcacttcgcccgactcgctgccggtctgctcgctgccatcctcggcggccagaacccacgagcgcatcgtgaccgtctcgtcgacaggcgagccccaattcggcgcgaacgggaacagcacgatgcgtcggccggtgatcggcacggtgtaggtaatgccctcgacagtgaagttcgcatagctgtcgatagtcggcgggccactgagttcgatctgcacggtgaagtccagctcgcgcagcggctccatctcgtacggcagactcacgccgaccggcagcgacatcgagatgcctgcctgcgggccgagcgcggcgttttccaacgtctgcggcgtgacgtacgcattccacaggatgatgtggcgtacctgcgtcgacagcaaattgccggcgtcgagtgcggccggcacgatgtagatgcggttgtagtagtcgtcgaagaagctggtcgacttgcgctggccggtgacgccccaatggttgtcggcatgcacgcgccagcgcccgtagccgccttgaaggcccgggcgcatttcgtaaaagtcgaacatcgagacgacttcggtgttgtcgtccaagtcctcgctcagcatcgcgttgttgatgccgcgctcgacttcgctgctgaattgtccggtgatgcctgccatgagttacggccccgtgtagcggatcgcgtaggcgaaagtgccggagtggttcgcgcccgtcgaccacgagacgccgttgcgcacgtcggcgttcttgcggtggaacgggtacaccttccagcggtcggtgccgtaggtgacgatttccccggacaggtggttgtcgttgcggcacagacgtgcgttcaccatgtcggcaacgatagtctgaccctgcgagagacgacgctgcgtgaccagcagcggcagcagcaccgtgttctggttgaacatcgacggcaacgcttgcagcaggcccgcaacgacatcgccggaaccgacgaggttgccgtcaccgttgtagacgcgacgccacgcagtcgaatcgaggccggtgtggatgtaggagcaaccgagcgcctgcgtgtaatactcggcgaacaggccgcagcccatgcccgaccaaccgaagccgaagccgaagtagctcgcgtcggcgctggtgtacacgagctggttctggttcgacgcggcgttctcgttgaacgagcccgagaaccacatgccggtgccgccgatctgctggatgttcgacttgccccacgagagctgctggtacttgtcggcgttgtagttgaccacgaggaacacttcgtccgggccgacgttgatgtgcaggtcgtaagtcgccgggaaattcatcggcgaaccctcgaagtccatgatcttgacgccgttcggcgcagcgccgggcagcgcgccggttgcgcttccggtgccggcctgcaacagcagttgtgcagcagtcgcagtgaggcgcaggtacatgccgttcttttccagcacgccgtcgccgttgagcccccagccgtttgcctgaagtgcggtctcgaccgaattcttcagcgatgcgaacgaggaaaagttgccggtgtagtaagccattaggtcatctccaatgcgataaagctgcgccagtcagtttgattcacgtcctgcaacacgacgaacgcacgcccgccggcagtgagaatgtccgcgacgtgatcggcgatgctcaggcccgccgggtcgacgtaggtgccgccgacctgcaacacgttctcgacgttgttgttgaagccggacacggcgtacacgccgtccagctcgccgtacaccgcaccttcccacacgccggccggcgcgctcgtggtgtacaggatgatcggctgcggctggtaattcgtgccggccggaacgagcgaacggctttggtcgccgccggtcaagtagttccagttttcgagcgcgttgtaggcgctcgacgcatcgctgccggccgggccgttgtagaacgggaagtgcgacagccgacgccacgtacctgcttgatcgcgcagccacaggtacgacggacgcacgttcgacgaagagccgcccgtatagcccgactcgcggccgtgatacgggaagcggtagtcggtgtcgctgaaacgcttcggtgctgcaccgtcgaacatgccggcacacaccagcggcgacgggaactcgcccggacgcgagtagggaaacatcttgcctgcgtagaagtgggtgtagaccggagtgccgaccttgaagcagcccgcgatgcgttgcgcgttcgcagtgatgaagtacgtcaccgcgttgttgtggcaaggcacaccactcagcttcgcgcccggctgcgagtcgaacgagttcgcggagacgtagccggtaaacgtgccgacgagcatgttgtagtagtcgccgctcacgctgctgtaggtgcggaagccgatgtagatgtcttcggtgcccgacaggccggacgagttgaggatcaactcgcgcacggtcccggtgttgacgtagcgcagcgtcgtccacccgttcgcctcagcgagcgtcttgatcgcagcgagcaccttgtagtgcgcctcgtcgccgctgccgccagtcacagttgcaattacgtgtcccatgtcgattccttatgcgagaagtttcttgtacgagctgcggtcagctttgattgcgttgaagatggactggcgtcctgcgcgggtgttcgcgccggcagcgaccacgctctcgctgtcgatggtgttaatgatggacacgtccatcgcaggctgagcgccgcctgccattccgccgttaaagcggtggcgcggatcgtcttcggtcagcacttcctcgttgcgcttcagcaccgccggcacttcgtcgggcgcgaggcccgcaacgccgcccgtgtggtagcgcggcgcagcctcgaacacgtacgccggcaccgacgaacgacggccggagccggaaccagcgaggccgccaacgtgcaggtagctcgcgaccgcgctgataatctggccccagccgccgccgctgttctcggccgccgccttcagcgcgttgaaaatcgcctgctgaataatcatctgcgcgagctggatgaggatgtcggcgatggtgttgagcacgatgtcgccgaatgccttccatgcgtcgccggcatcctgcacgcccttcagcgtgtcggagatgagggtcgcggtctccatgaacgcctgaccgaagccgttgacgaacacgtcgatcacctgtcgcttctgcgcgctgagttcgaccgacatcgcctgaatctgcgcgctcaggttttcgaggcttgcgcgcgcggcctgcgcctgcgggccgtcccccagcgtcgccatgaactcggcggccttcgcgcgcaacgcttcgagctgcggcagaagacgcgcgttgacttcctcgatccgggttgcggcttcggtggtcgtcagcagtccggcctcttgcaaggtgttgatcgcatccatcgacgactgccgctgttgcaacaggtcgttgatccgctgctcgtagaactcctgcgtcgtcgcctgctgctgtgccttctgcaactcaggcagcgaattgatgcctcgctgaatctcgcccttggccgcatccgactgaccgagcttgtcggcttcgcgcagcatgcgttccagttcagccttgcgatccgcgatcttgttgtcgatcacagccagccgcgcttcgagcgtatccgggcgcgagttggcgatgtcgttgtcgatgtcgcgcagcttctccgctacgtcctcttccagacgcagccggcgctcggcgagcgcggccagacgcttctcttcagcctcggccttcttgcgcgcagcctcagccgccttcgccgcctttgcgtcggtgccagcacgcgcagcagcggcatcggccgccgcttgaatgcgcttgaactcagccgcaagcgcgtcgttctccgcagccgcctcgcgtgctttcgtctcgccgatctgccggctggcggcagcgacttgctggcgaagcggagcggcacgctgttcgagtgcggcgagctgtgcttccagtgccttgccttcgttctcgacttcccgcacagcggcgagctgcttggccgggaaattcatgtcgtgctcgcgcgtaccctgcgcaacgcgaaccgccacttggtttcggcgtacggccgtgttctcgcgaatctgcgcttgcagcgactccttctgcttgtcgtagatttcgagcagccgcgacgccgccgtgacctgacgttcgagttgttcggcgttggtcttcgacgtgtcggacaggctgcgctgcgagacctcgaacccacggttcaagtcgttgatcgtcttctgcgcgtcgaccttgaccttgttcgattccagctcgcccttcatctggaaatagatcgggatgatgatgcccgcagccgcgatggcgaggatcgcggcaatcggcccggagatgaggccgcccagcgcgacacccgcgcgacccgccgacgccgcagtgccggcaccgagcgcagtgttcagcgcgagcgtcgccgcacgcgccttcaggatttccgttgcgagcgacgtgaacaccattgcgatgcgcgcgccctgaatcgccagcatgatcgccagcagcgccttgaagttcttgatgaggaacgcaacggtgtccgccaccagcttgatgatttcgtcgttctccgcgagcaccttcagcagttcgccgccagcgtcggccgcagcgacgaacaccttcgtcaagttctccgcgaacttcttgccgtcgtcgctcttcaggtacttcgtcaggtcgacgaacaaacgacgcagcgcatcgccgaggccgccgtcgatgatttcgcgcttcagatcgccccatgcgttctgcatgcggttgaggtcgccgagcaaactattcgacgcagccttcgcctgcgggccgtagatgccacgggcagtctgtgcggcgagcagcacgaactctgctttcacttcgccgcccttttcgagcatgttgttcaactcttgcgtcgtgacgccgatggccttcgcgaacaggttgaacgcgccagtcatgcggtcgcccaactgaccacgcagctcttccgcttggatgaagccctttgagaagatttgctccaacgcacggaacgcgccggccgtttcgtcgccgctcaaccgcatcgcggtcgcagcttcggtgaacgcctcgaagatgtagcgcgtcgcctcggtgctcatgcctgcgtcgcgtgcagcgacggcgaagcgcgagtacgactcggacagcggcccgaacgcagcgcccagctcgtcggccttcttgcgtaggtagtcgtattcttccgccgccgcagtctggttgcccttgttcgcgatgagcagacgcgacatgacgcgctcgcgttccagtgccgcatccatcgcgctgttgacgaggttcagcgcaccgaacacgccgacatacgcggagaccagcgagagcacctgaccacgggtgcgctgatacagcgacagcgcggtacgctgaccgtcgttgaagagcttcaactgcgtgttggtcttcgcggtcgtctgctccaaccgcgtcatcgtctgcgcgacctgctcctgcccggtgcgcacgcgcgtcgcggcctgagcgagacgctgctcgatgccggtcaggttgttgagcgtgatgccggcggcagcggcgcgctgctgcacacggttgaacgcttcggtctggcgcgtcagttcgccgtgcgcctgcttcatctcgttctgcgcgcgctgcaacgacgccgccagttcgtcgttcggcttgtcggcgcgctcgaccgcctgcgcgtactggatcacttcttgccgcgcttcctcgaaccgctgttggctcgcgagcagcgcggtgttctggcggttcaattcgtcggcgagcccggcctgccccttcagcgcatcggcggcagcgcgcagccggcggctttgatcggccagcttgtcgatgccgtcagcggcttgcagggcgtccggcgtgagcgccttgaattcctcgtcgagctggtcgacggccttttccagccggtcgagcgtcgcgaccgcatccttggccgggtcgagaagcgcctgtacgcccgcagcagccccgctcgcggccgacccgctacccacggcagggacagccgccgcgcgggccgcagcgagcgcctgcgtgccgcccgcgcggaactgcgccccggcctgagccgccttttctttctcccgggccagcgtgcggtagacgttggccgtcagctcggccatcttctgctcgcggcgcatctggtcttcgcgctcgcgggcggcctgttccagcttcgccgccgagtcgcgggcttcctgcgcggcggcgcgctcagcctcgcgggcctgctgctgcgtcgtgcgcacttccttgacggcggcgtcgtagcgctccacgttgtcggtcgagcgcttatacagcgcgaccgagctattgagcgcctgattgacttcggcctgcgactgcgagaagcgcgtgacatccacgcccatgtcgcgcagcttcgtgccagtggtttccagacggcgctcgttgttgcgcagcgacgattccaacctcgtcacttcgctggcggccgtcttcaactgctgcgtgaattccttcgacggcttctccgtcttgtagaactcctgcgcgagcgtgttgaggttgtcgcgtgcgcggctcagctcgtcgcgcagactgcggacttgctgctcctgccgcgagtacgcatcgagcttggaagcgcggtcgttgagagacttcatgatcgcgagcaactgctgctgctcggacttcaggctctcgaacgaccgctccgccagtcggttcgcatcggctacttgctcttggttatctgcgatcttgctcagctcgtcgttgagctggttgatggttcgcgtgctgaggttcttcgcacgtacaatcagttcaacttcgttctgagcggccatcgcctatagtccttcgatgttttctttgaatgccgatgctgctttcttgctgagcgccgaggcgatagcactctgcgtcagcgtcatttcggttctgattctgttgttcacccgctcgcgtgcgatttccgattcgacgatcaaatacccgagcggatattcgccagcgttcgagtgaccttcagccgtcaggaaagagacggctgcgcggatgccgagccaccattcggcgaagcgctggcggcgagatttcggttgctgttctgcggcactacgccttttgcgcttcgcagtgccgcgaccacgtttcccacgaattctcggaagccggcctcgtcttggaacgtgagcttcgcgagcttattcaagcaatcgacctgcacgggcgcaggcaggtgcatcaccttgctccactgctccggctcgtgcgcggagtacgcgatgacgtgcgcgatgaaatcggggagctgcacgagaagccgctgaccgacttcgacgatgttgacgttcgcgaggtcttcggctttcttgacgccggcaccttcgacgatgttgaagatttcttcgatgttgctgagctgcgacaggatgagaccggcgatggcgttggcgctgaggccgtgcagcacgatgtcgtgctgctcatcgttcgcgccgacatacggaacggttgcagtgcggagttgcaggttggcaagggacatgcgtttttcctctggtggttatgagacaggccgccccgggggtacccgaggcggcctgtcaagttggtcttggctcgcttggtcttgactaagttggccttgaccgcgtttgacgatccccggttacgcggcggtcgggcgaccgtcgatgtactcggaagcgtagccgtcccgcttcaggatgtcgaatgcgaacgaaagctgctgccattcgtcgcccttcatcgcgaagtcgccatcggcccggagctgcacgtacggccagtagtagtcgcggcgcggcccggtcgggttgtacgagatgaagcgcagcgcgccttcgatggtcgtgccctcgcccaccacgatctgcgtccgggtcgacgcggcggtggcgtaggtcacgatcagcggctcggtcccgtcgatggccccgcccggcacgatgtacagccggcccagctcggggtcgacggtgtagtcggtcaggttgtcgaaggtcgtgccgaccggatcgctggtgacgctggtcagggtcacgttgcgatggccggtcgggttggcctgcgactcgccgagctggatgtaggtgcccggcttgacgcggttggccgggatgttctgcaccacgctggcggtcgccgactgcgcgaccacgttctgcgtaccgaggaaccacagcgcgatgttctcgtcgctgatttcgtcggcgatgaacgtgccgctgtcgttcttttcgagcacgatgctcttgtccttgacgcgaatgccacggtcactgttgaagtgatcgaggttttcgctctcggtggtgcggttcaactccggcgtgttgccgaggtagcgctcgccggtcttgttgaacgtgcccggtgcgaacttgtcgaaatgcagttcgccacggccaagggtgtaattctcgctgcccatttacggtctccttctgtcgatacaacggttaatcacgaatccagtacgggtctcccaccttttcgacgacttccagacgaatcctcatccagaaatacgccttttcggattgctcgtcgggagggcgaacaaccccgggctcgatggacagcgtgtttgcgagaccatcgaagaacccgctttggttgcgcggcaccagcagcttgccgagcgcttttttcacgtcccccatgagcagatgcgccgagtcttcttcctgctcgacatcgccgccttcggcccatccgttcaagaggtaaatctggtcgtacttgtgcttggtgccgacgacgccgccgatggtttccggcagacgatccgggttgaagttctccaacaccacgagcgccggcagcttcacttccttgccgaagttcttcttgccccggtacaccgaagcgaggtcgaagttgtagccattcgccgttgtgatttcggtcttcaggtgattgcagattgccttcagcagcagcagtcgtttcgtatcagccacggctcagtctcccgtagttgcgcaggaagctcgattcgagcacgtcgccgactggcccttgcacatcgaatcgaacatcgcgaaaaacttgatcgacagacgggccgtacagcaggtagagattgccgctgacctgcaccatctgcttcttgttcatgccgcccggcagcttcccgtcctgcaaccgcacggcgaggccgacgttcgcgttctccgggtcgtatacgccagtaccgcgacgcagcttcatcgggaacgcattcgggatgcgccgcgctgcgccagccgccgagaccttgacgcgcgcgtagccgcccttgccgagcttcgcgccggtcatgaactgcgcgagcgaagtcgggcgcatgcggccggcaatgacgccttcgaggtcgccgacgcgcgccttcttcgacacgcgcagtcgagcgttcgggttgtcggacgtgccgatgtagctcgccttgaatgcaacctgctcgcgaatgcggcggctgctctcggcctgaccgaacgtgactgcttcgttgatcgcgaacgcggaagcccggtctaccgtttccggtatcccggcaacgcgcttgcgcacgtcgtccaatccacggaagccaatctcgacggtcacggcgctacctcagtcacttcccacttgatgaaaatgtcgtcttccgcttcaccgcgcacatcgagcttgaacgcacgattgagctgcgggaagaacacgcggtcgccttcgtcagcgcccacgaaaatccgggtgtcgatgatgatgtagtccaccgcttcggtgacggtcgcgaagccttcgcggtccaagtcgccgaacgtgcgaaccttgtagtgcagccgagcggtgccgtcgacgacagcaccgcccgacttcgggcgaaattgggccggcagaccaaacgtgctatgcacggtttgccgagccttctgcttggtttcgagccagcccattccgttctcccttcagcgcgccgggcttacttgcccgcgccctgcttgccgccgctcttggccgtactgtcggtcgactcgaccttcggcgcggtgctcgggttcgacgacgcagccggagcctcgtcctcttccttcgcggcgtccttcgcggacttgatgtagccctgttccagcagcgagtcgtagagcttcttgtcgtcggtgccggccttggtgcccgcctgcacttcctgcaacgcggtgccgaggccgtcttcggcgtcgaaatcgcccttcagcgccacgcgggccacgaacttgtacttcgccatcttgatgctccttctttcggttggggagttgtgttgctacagcgaagcccggcgaaccgggcttgccgtgtgcgacgttgcttacgcgacgacgcgagcccgcagcgtgcagttcggacggctcgggatcatgagcggagccgactgcgacatgaggtagatcacggacgggtccgggttcttccacatcttcgggaagatgtcgagcgcctgaagatcggcgtccgcatccatgatcgcgccgaaggcacgcacgccgtcgaagccagcctcggcttcgagcagcacgtcgcgcgggtccatcatcggctgcatcgtgccggtctcgtcctcgtacacgtcgttgtagacgtagatgttgaacgagccgatctggcccttgaactccaccgactcgccgaggcccgggccggtttcggcttcggacttcgagccgcgccgggtttccagcagctccttgatgaccgggtgcttcttgaacgccttccacgcgaggcggcccatcgtgacgcgcgtgacgacgaaaccttcggcgtcatgcacacgagcggcccactcttcgaggtcgtcgtccgggtcgctgttcgtctggtccgtccacagcgcggtgccggtcaggatgacggtgtggttggcggcgcggccgaagtcgatggtgacggtcgggtaatcctcgcccgaaatcgtgacctgaccgtagagcgcagcctgcgcgcccagccactcccagcggcggtaaatctggttgcgctggtcgagctggtacgcggccaccacggcacgccagcgctggccgggcgtcatgtcgccggtcagtgcttcacccgcgaggcggcgcagcatgcggcccggggtaacggcgtccttcggcttgacgtaggccggacggaacgacttggtgtagaagccggaacgcttcaggactcgaccctgcacgttgggagccacgaacggagccatgcgccggccgagcttcagctcgtcgaacatgatttcttcggtcgtgaagttgatctgctccttgtacagacggttgaggaaatactgcacgggtgcccggctgtcgacgatcaccttgcgcagttccgcagtgctgaacaaatccatcgttgtctccttctatttcggtgtgtagttgcgaaacgtcttgctgttggtgatgccggcttagaccgggccggaaccggccggcgggttgccgtagagcttctgcgcgacgatgttggtgccgtcgaacgcggcggccttcagggcgtcggtgttggtcgcggcgttgaaggtcagcgcttccatgttgaacacgccaccgacgtagatcgcttccttcttgccggcggtcggggtcgccacgtcgtacgcgaggatcgcgatggcgttctcgctgccatcggtcgcggccggatcgtgcttggcgaacaggccggacgcggtgacgcggccgagaacctgaccgccgacgtacgcgacgccggtgacgagtgcgccctgcgtgctcacgatgtcggcttcgccggcatagagctggatgctgttcgtgtcggtacgagccacgtagccagcgatggggccgaagttggtcatttcgttactccttctgtgattgacggttagccggatttttcccgtctaggctggcgacggtgtgccgatattacttgacgacgcgaagcacgctcttgttgccggtggcagcggtgtacgcacccagcaggccgccatcgtcgttgccgcgcgcctgctcttcttcgtcgccgccgttgttggcgatgtccgcgccgccgccggagttcgacatggccgcgtccagtgcggacgacgcattggcctgcttcggcgaggccgacagcatcgacttcgcttcgtcgaccgacatcgtggtcttgaacgcgatgtggttcgccagcgcctcgcggcccttggcttcctcgcagccggtgatcgccgcgcaacgcgcctgcatggccgcgccggcatcgacctgctcgtcctgcttcttgcccgcgtcgacggtggtgtcggtggtcttgttttcgacctgctcgtcggccttcttctgctcgacggtggcatcggtcttcttcgtgtcgctcatggtgtcactcctatcgttggtggaagagccgaagacttcggcccggaaggtagcgatggcatcctgtggagacatcaccgcatcgaccaagccgattttgaccgcatcgtccgcctgatacacacgggcttgcgtgtcacgaaccgcttgttcggacatcccgcgattgatcgcaaccacggagatgaacttctgccacatgccgtcgagacgcgcctgcatgtctgcacgcacgttgtcgggaagcgggctgaaggggttgccgtcgaccttgtgttcgccggcatggatgagggagatggcgacgccgaacttttccagcgccttgctcatgtcgacgtgcatcgtcagcacgccgatgctgccgctgtcgcccgaaggcgtcgacaccatgcgctgcgcggaactgccgagcgagtacgcgcccgacatcgcgcctgcgttgacgacggacagcgacggcttcgtgtcgcggcccttgcggatgtgctcggccagctcgaagttgccgtacaccatgccgccgcccgagtggatgtcgaacacgatgcccgccacgtccgggtcagcctgcgcggcgtcgaactcgcggcgaatgtcgtcgtagccgcgcgtgccgtaccacgggtcgccgttgcgatgcacgagcgtgccgcgcatcggaatgaaggcgaggccgttgctgaagaggaacggcttggcgcgatcacgcgggaacgacacgtcgaacgcggattcgaccgctgcggtgatgccttcctgcgcctgcgcgcgctgctcggcgctcggcgggacggtcgcctgcgccatcgtcatgcacagcgttgcgaccttctcgacatcgcgagggtcgatcaacgccgggcggccgttgaatccctcgacaagcgccatgcgcattgcgagcagttcattcatcgtcgttctccgtgtcggtgtcggtatcggtgcccgtgtcatcggcgttgttcgacgcacggctgtcagtttctttctgcgtgcccggcttgctggtgctgagcgtgaagttgagcttcttcttctcgatgaggcccatctcgcgagcgcgctgagtgaacacttcgcggtagtccttgccgagcttgccgagttcttcttcgtaggtcgacaggcccgacgcgatgcgcagcacggccgcctgcgtttccttcagctcgtcgatctggccgcgcgacgcgccgatccagtcgcaacggcaatacgcctcgcggttgatgccctgatagaagtgcgcagcgcccttcggcagcggaagatcggtgtccggccgattgatttcctcttcgagccacagcatgtagatgagcgtggcgaagcggtcggtgacgagcttcttgcgcgtctgcatgtacttccacgtctcgatcatcgacgcgcgtgcggacgagtagttcgtcttcgagtagtccttcgagaactgctcgtacgacaggcccagcgcagcgcagatgtgccgcagcagcgagtcctcgaagccgctgccgacgccgcccggctggccggcgttttgcaggttgagcttcgtgcccgggaacaggtgcggaatgcgcacgccgtcgatggcgaggttgtcggcagaaccgacgtactcagccagcgcgcccatgtacttctgcaaccagcccatgtcgccggcaccgagctgcgagaacaccagctcgcgcggcagctccgactcgattgcagcagcgaaggtcgcattgacgacggcgttttgcagaacgatgtccttgtagaccttcgtcatgcgcatttctttcagcaccgcgaccatcttcgacacgccgcgcgtctggcccgggcgcagcacttcggcaatgtggatgatctgcggacggccccacggcttgaacgccggcacgcgcgtccacttcgagccgaagcggtcgtagtacgactccatcgggtgcgcgtcacgaatgtggtacgcctcggccgcaccgaacttgtcgatttcaacgccgcgccgcatgtaggcggtatcgctgttgtcgttcgggttgctcaggcggtcggggtcgatcatgttgatcgcggtcttgtacggacgaccggacttcgacaaccactccgcagcggcgagcgcttcgcccgacatgaaggactggccgagcgccatgcgcacgaggcccgtgagtccgttcttgcgcgaggcgtcgatccagttcatcggcgattcggcgtacagcatgaacttgcgttcggcgatgagctggaactcttcggcccacgcttcgctcaggcccaacgtctcccaatcggggcgcgcgttgaggatgtactggccgccgacgatggagtcggtgctcgtgtcgagcgcgccttggatgtagccgtcgttgcgaacgagttcgcgagtgcgcgcgtcgagccgaaccttgtccggcgagatttccatgtcggcgggcagcgacggcgcgctccacatcgcggtctgtcggttgagacgcgacgcgccttcgtacgcaccgccgaaggccgactctttgccggtgctgttgaatgcttcgtcgccctcgggggagcgaacgacagtgagtgctcgggccatgtcgttttaccctcagaagaacggacgaagggggccgcccgttactgcgacccccaatagggaattgatctgtgcctgcaaagtggctatgtatttggcgaggccggttgcgttggctcggctgtactcgacccgctccccgttctggtcgacgacgacggtcacgccgccgccgatcatgacgctatggtaggcggtttgtgcttccgccagccatgcttgcaactgctctagagtcgccatctctcatcccaaggatttcccgaacttggcgaaaccataatccgtgatggggcttgacgcaaaccgtttttcctgatccacacggcgcacaagagagttgttactccactccgcgtaccacgattcgggcgagtcccaatcgaatccttcgaccttcaagatgacgcacaggccgaggcagtagtagcccaagtcccacgcttcgttgcgtcgcttgcccgggttctgccagcggccacggtcatcgcggaactcgacagtgagttcggcatacacaacttcaggtgtccacttgttcgtgaagtggcgaccgccgagcgtcgtcttctcgtcgtagtcgaccatgccgagcagcatgtccttcagcacgttcgagttgaggaacagcaccgggatttcaccgcgagcaccggccgaacgatccttacgatccgagtcagggaagtcgacttcggcacgcggcgcaccgagcttcggctcgcccttgatgagcagcacgcgagcgccttcgcctttgtcgcgcatcgagcgccagtagttgtacgcgcgcgtcgtcgaacctgacttaccgccggagtcgatgccgaccatcttgatcgacatgaagccactgccatcttccaactcgtactcgcgctcgacgacctgctcggtgatgagttcccaatcttcctgcacggcgtacggcttgacccacagcgtatcgccggcatcgtcttgccgcttcgacttctggatgtcaaatcggtcgacgaggtacaggtcgaagttgacgccgttatcgctcgggccgacgccgaagacctgcacgacgaagcggctcttctgcacgtcgacggtcgcgagcaggaagcgcgcaccgtacggcaccttcttgtccgcccactggatcgccttcgattgcaggtcttccggcagacggttcgagtccttcgcgttgagcggccagaacgcttcgccttgatcggtgttgaccgtggccttcagcgccttcgtttcgcctgtgcgttcgagcgtctgctgcgcgagcaggtagcgctcgacaagcgtctgccacgtaatgaagcgcgccgccgggcctttcagccagaacgacgcgctgcgcgaacgcacaccgacgccgaggcggttgccgtcgcggtcgagacgctggccctcgcgcagccacacgccgcgacgattcatctcgtacttgtgcttcggctcgatcacgcatccgttcttcgggcacgccatcatcgtcgccgcagcagcctcgaacggatcgggattcttgaagtcccacttcagcagcgcgaacttcggctcgaaccactcgccgcagtgagggcactgccagtagaagcagcgacggtcgccttcgttgtacaggccaccgatgccatcggtcggcgggaacatatgcgagtccgggtgcggcaacttccacttcgggtctttcacgtcgaacgacggcgacgactcggccagcgtcatgccgaacgaaccgaacgtcgtcgtgcgcttgcgcgcgagcgggaacggcgggccgttcttctccacgtcctgtggcatgcggtcgtagtcggtcagcgcaacgcgcggcaccggcttgccggagagctgattgatcgtcggccagcccagcgtcagcatcatgccgttgcggtagaacttgtcgaagatgttgtcgttgtcgctgccgggccgcagcatcgcgcccagctccttgctgtcgcggtgcatcttgtcgatgcggcgatacgagaagtcgcgtgcagtgtcgcgcgctgtctggatgaggaagaagtcggccgggtcgcacttcgccgtgtacgcgatccagttgaggatgatttcggtcttgccgccctgcgccgggcctacgaagatgcacgactcgaactcgcggctcgtgagcacgtccatcggctcgacgaggtacggcgtttcgtcgttgtcccactcgccgacgaacgaaccctcgttgtcgaggtatcggtacttcgctgcggcctgagaaacggtcaagcgctccggcggaaccagaacgctatcggcaacgaacgtgaccagctcgccgaggtcgttgaagaaattaccgtcaagcatcgtcgtcttcctcttcgtcgagaccgatgtcgtcgagcttgatgtcggcgagctgttccttgtccttgatgccgacgtaaatctcgaagtcttcgacgaggcgcttgcgcagcatgtcgatggccttgtcggatacctcacgctcgatgatcgcgcgctgctccggcgtgaggccggtctgcgcttcgatgcggtcggccaacagccgaagcgactgtgtgagcgagcggaacacgccggtcagcacttcgagcacctgctgcgtgcgccacaagtcgcccgactgttccttgtacttcaacttgctgttctgcgcgttccagtattgcgcttgcagcggcgcgggcaggtcgccggggccgacttccgcgaggtacttggcgatgtcgacgatgggctccacgaggtagggcgcagcgtcgacgatgtggtacgtcggtgcgccgcgacggtcgccggtcggccgcagcgggcgcaacttctcagtgacggtgcggcggtcgaggcggaacaactgcgccaaacgcggcacagtcatgccgtcgaaaaactcttcttcgtagtcgatcttaggtgcggccattggctagttctctctgtacgtctgcgactcgtcgccgcatgggttctctcagggcgtcttgggtaatttctttcttgaccagctcgcgtgtcaaatcctcttcgatagtgcctactgctgtcaggtgcatcatgttgacgtggcttcgagtctggccgcgtcggtgcagtcgtttgcgcaactgcatgtagagttcgaggtcgggcgtgtggtcataccagatgaggttgttaccgcccttctggatgttcgtgccgtgaccgatgctcgcagggtgcgtctccgctatctcgatgtcgccggcattccatgcgtcgaggtcgcgcttcgtcttcagcgaacggatgccggggaactcgtcgcgcaggcggtcgcgagagtgctgccaagtgcgcgcgacgaggatcggcgagccatcgctgaactcgacgatttccttcaagcgctcgatcttcttgtcgtgtatgtcgacgaactctttcgtctcgctgtcggtgtagatgcgaccgcacgcgaactgcaacagctttccgtacagcgcgccttccgatagcgcacgcacggccgggtcttgctcttcgccccatttcagcacagacgtacgctcgaattcctgatagcgagccatcacatccggcggcaggatgatcggcacaggcgtagagcggagcggcggcagcttgacgtaatcctcttcgcgcagggtgtacacgatgtcgctgagcttcttcgtaatcgacgccatcgcgtgcgacttcgggatgaccttgcgacccatgaactcttgcttgaaccagcggaacaggaacttcttgtacgtcaggcccagcctctcgccgccgtcgatcatcgcaatctgcgaccagacttgatgcaggccgttcgggctcggcgtacccgtcagctcgatcacgtcgttcggttgcccccacgtcaggcgcacgccgtacttccaacgctttgacgacttgttgcggaacatgctcgattcgtcgaacacaaccgcgtcccacggcacggtatcgccgcgcttgaacaacgctgccagacgcccgagcttatgcaccgagatgccgtcgacctcgcacggccgctgcaactgcatgcgcatgtgctcggtgtcgccgtcgagttcctgatagtcgaggaagcgggtgtgctcccaattctttacttccgtcgaccacgtatccgagatgacgagcggcggaccaacgaccagcacgcggctccactcgcccgagaacaccttgtccgagacgtgcgtaagcacgacgacggtcttgccgaggcccatgtcgatccacaacgcgcaactgccgacccgttcgaggaacaggccggcagcgatttgaaactcgtcgaggtcggagcgcttcagtagttctttcattcaaaaatccactcggcgaattctttgtcgaagtagtcgatgacccacacgatcatccccttgcgtcgcagctccttgtgctcttcgagctgattgtccgtcgccttgccgccggggcgcttgaactcgatgaagaagacgaacccgttgcgaatgaacatgcggtcggggacgctgctgttgccgggcgacgagaacttgtatgccttccatccgtgccgcttcgcaacggcgcaccacttctgctccacatccttttcgacgcgatgtttgtcggtcggcaggatgtcgccgcgcggcggcttgccgttgattacgtttcgccagtcggttagccaagtcatttctgatagcactccactacgtcagccttcgcgcgaatcggaacatcttcgccccaccacttcggcttcttgaccatctgctcttcgagcgttgcggccgagatgtccgacagcttcttcttgaccagcgcaacgatttcgtcgtgtacgtgcatgcggacatcgagcccggacttccatgcgcgcagcagaccggcggccagcaactcgcgtgcgattgcctgcaccaagttctcgacgatcttgccgccgtgcgagtcgatgcgcgtccatttcttcttcgtgttgtagccttcgtacgtgaagcccttcttcgacttgtacttcggcttgccggtcttcttgtcgatgccgaccttgatctttttccagatcatcttcgggcgcaggtagtgcaggtagcgaccggacggcagacgcatgcgcaggaacggacccttcacgtccatgagaatcgggccgacgcgcaccggctccttcgtgttcatcaccttcgcgacggcgcgttccagctcgtaccacagctcgacgatttcggtgtattcctcgcggaagaacttcacgacggccgcagcatccttctgcgacatctcgatacccatgttctccgcgtagccccacaggccggtcttgatgacctcggggtactcgcccagctccataccgccgctgaggcggaagcctgcgccgagcacgccgggcttcgcgtgttgacgcatccacttctcgacctgctcgtagtcgaccttgtacatcttcgatgcgaacaccttgtacacgtcgaggttcttctgaaagacctcgatcaacttgtcgcagcccgacagccacgcgatgacgaccgactcaatcgaggccaagtcgcaggttgcgtactcatagccgggcggcgctttgatcgcagtgcggatgcacgatgcaatcgcgcccatcggcgacgacaccagcaggcgcacgaactcgatgtcttcgcgcatgatcgcgtcgcgcaccatgagcagtgccccttgttcttctagttcgcggagggggcggggcaaattttgcacctgcaccgcgcgcccggcccagcgcgccgtacgtcccgcgcctgcgaactgcatcgtgtagcacagcactccgtcgacttcgatgtcgagcatcttctgcaacttcgtcaccgacgagcgcgccgcttcggcgtgcaacgcgagcactgcattcgcgtcgtcggtcatgttccaatcccaatcctctcgggccttcttgatcgaggccgatttgaggttggtgaacgggtagccgcgctcgcgcagccacgggagcaactgcgtgccgctgccggggttgctcaggccggtgatgcggcccatctcgcccagcaggcgcttcttctccttcgcgatgacgcgcagcgcggtctcgacgaactccttgtcgaacggaatgccgcgttcgttgatgtgctggtcgatgtaccacaggttgcgctcgaagtcgctcatcgggaagagcgcgagcttgcgaccggcagcgcgctcggcgatcacgtcgcggcggccgtactcgacgaacgtcttccacttcgccgggtcagtcttctcggtgttgcgcgtgtactgcttggtcttggtcggcttgcgcggcccgcagaagaatttaacgagcgacttgccttccttcatcttcgcgttctcgccgaggcgcagcacgcccgagagttcgtcgaggttgccgggcagcgagagccagaatgcgtgcgccatcgagcaatagaactgctcgataggaatgtcgatgccgagaacgtgcagccaaatcgcgcgctcgaactgagcgttgtgcgcgcacttctgcacgttcgggtctttgagagcgcggcgcagacgcttcggcatcggctccgtcgcggggaaccagacttccggttcttcgtcgttgaatgcgtaccacaggaacagcacttcggtcgacttgtcgcgcgcgtatcgcgccaagccgtgcttcttcaggtcgcacttgctgaaggtctcgaagtcgtgatgcagcttgtccataccgtatccctgaaaaacagccgcccggggagtgcccgggcgaccgtaggtaccgcttaccgatgcccgattttagatgccgaggtcgtcgtcatcttcgtcgtcatcctcgtcgcgcgagcgacggctcttgctgctggtcttgctcttcgacgagcgactgcggcgcgagctgctgtcgtcgtcatcgtcgtcgccgagcccgtcatcgtcatcgtcctcgtcgcgagaacgacccttcgacttgctcttggacttgctgcggctggtgctgctgtcatcgtcctcgaagtcatcttcgagttcgtccagaacctcgtcgacatccgggcgagcattgcccgcgaggttgtcgtcgtggtcgacgaactgcacgatgtcgaagccggcattgatgcgcttgccgtacttgttcttcttcttcatggacttgccgttctgagcccacgggcggatcaccacgttggcccacgcgccgctgtacagcagctcgtcgtcttcctcggtaggctgacgatcacggtcgacgaggatcggcttccgggtctcgcgaaccgtcaccgtccagcagccgtggtggtcttcgacatccgactcgtcaccatcacgcaggaacttgcggtcggccgccagcttcgggttgccgtactcttcctcgcacatctcggagatgaggcgggagagcttctgcgcgacgggcttgtgcgtcgccttcgggagcagcagggtgacgcgatacgacttcttcttgttgccgttgtcgtcttcatgctcgtcgggctcgaacaagtacgggaagctcaggcgcacgttcttcagcagaaaacgcccattgcccttgtcgaccagatcaccaactttcttcttcgccatttcgatttctccttcgtcattcgacgttcgtagttcgctttcgcgcattcgtacaacaggatgctcagtcgtcgagcaattcgagcgactgaacagtcaggtctttccgcttgtcgtctgcggagaccagacacggtttgccgggcttcgacttgatgaagtcctgcaatttcttcttcgcctcgccgcgcaccagcttttcggcctgcgcaggcgacacgaactcgggtttggagtacagcttcgactcaggcacaccggcttccagcagcagcagctccgcgtcgacctcactgacgaagtagcgcgagctgcggcctgccacggtcttcaggcccggcacgaaatcgccgtccgcgaccttcttgtgcaggtagtcttcgactgcacgcatgcggttctcgtacatgcccttgcgcagccacagcgccgcgatttcctcgtcgctcatgagcatgaggtcaggctcgacgaattcgtcgtcgtcatcgagcagcatgatgcgctcgtggtacaggaagtcgtggttcgcgcggcacttgaagttgaccttgcagaagcggcacgccttctcgctcgggccgaacggcgggttcggcttcagcgcgagcgcgaagcgctccttgatcttctcgccgatagcgagcagttccgccttgctggtgatccacacgtcgaagtgatcgagacgcggttgcgcaatgcggatgattacttcgtcgaagtcgtacagccagtcgtactcgttgataaagccgagcgcgtacatcacgagctgcttgttctgcggcgcatcgacctgcacgcggccgtacttcaagtcggtgatgatgagcttcttgtgcgacgctgcggcgtgatcgcacgtaccgaattgatcggggatcgggcaccacggggagatgttgacgcgcgtctcgacgtagtggtcgcccggcagacccatgatgcggtcgaggtatgccccgacaccctgcaccatctcgtcgtcgacggtgatcgcgaagcctttcgaggaatgctgctcttcgtcgtagtcggcgtcgaggtcgccgctgtcgaacgtcattcctagaaactcttccggctcgcggcgcgcgcgtgcgcaaatttccgcgatgtgatgcgccacggtgccttcggccgcttcgtaaatctcgcggtcgggctcgttctcgttgagcagcaggcttgccgggcaatcgtaaatgcgatgcgccgacgatggtgcgaagcgagcatgagaaccgggcatgtatttctctccgaaagaaacgcccgagcgaacccgggcgtttcgtgtgacgtgcaggccgaattacttcttcgagccggcgcggttgatttccttcagcgcttcggcgtacttcttcggcgggatgttcagcacgttggactcgtcgagcttcgcgagcacttcgcggcacttgtcgatgcccttgctggccttcagcgccttgaaggcgttgacgacatcttcctgcgtcacttcttcgtcttcgtcgccgaggccgaggtcgtcgtcgccgtcgtcaccgaggccgtcgtcttcctcttcttcctcttcctcgtccttcggcttggacttgcccttggccgccggcttggtttcggtcttggccttgttggtgctgccggcgggacgaccgcgacccttcttcggtgcggcttcttcctcgccgtcatcgtcgccggcatcgctggtgttcgcggcaccgccgaaggcggcgacgagcacgggtgcgagagcggcggcaatggcttcggcgagcgacttcgcgttgagcttcgacatcggttgtatctcctagctaggttggttttgggagtgacgggtggattgcaattcctgcccggcgagcgcactatgcgcccgtcccgatgctaagtcaataggcatgctcatcgacttagcagaccccttaaatcccaatgtctgcgaggaattcatgcgccgagaccctacccttgattcactggatagcgcagatgcgcgagtgcgctatctgctccggcgcatcgccctcatgctcgacccgccgtacggtcgactcaacgcaatctgcgagaagtacaactggcacgagaccactgtctcgcgttggcagcgcctcggcggtgtgccgcgcgacaaggccacgatcttgcacaaggatttcaaccgcaagatcggcttcaacctcgaagaccttgttagcgacgacatcgcggagtgacctatggctgctggacgaccgatcaccagcgtgctccgtaagtacggcgctcaattgctggaaaacgggtactccatcttgccaatcccggcaggaaggaaaggcccgattgaaccgcagtggcagaaaatccaagccaccgaaaagctcgtgcgcaagtgggcgagcggcaactacaagcagggcaacatcggcttccacacgaagcacacgcctgcggtcgacatcgacatcaccgatgacgacatggcggcgctcatggccgagcacaccgaggaaatcatcggcaagacgatgacgcgcgtcggccgtgcgccgaagacgttgctcgtgtatcgcactgacattccgttctcgaagcggaagatcacgttcctcgacaccgagggccacgagcagtccatcgaagtgctcgcagacggccagcagttcgtcggcatcggcatccaccccgacaccaagaagccgtacaagtggacttcgggcaaggaactcaacccgctgagcgtgccggccgacatgctgccggaaatcacgaccgagcacatcgacgaactcttctcggtgttcaagctcgaagcgcagcgtcgcggatggacgttgaagaagcacaacgcaccgagcgagtcgcgcagcagcgacgacgagaacgacaacgcactgctggaatacaagcgcccgctggaaaacctgaccgaagaccagctccgcgaagtgctgcagtgggttcccggtgccgacgactacgagcagtggttgaaggtcggcatggcgctgcatcaccaattcgacggcaacgaagaaggcttgacgttgtggcacgagtggtcggagccagcgcacaactacgaccccgacgaattggagttcaagtggaactcgttccacgacgacatgggccgcaacctgacgacggccgcctcgcttatcaagatggcgaaggagcatcggcaggagcactcgcaggaacagttcgagaagatcaagcgcaaggtcgccgagacgacgagcgagatggagttgcttggcccgcttgctgcgaagtggggccgcatgctcgaaagcgacttccaagtcgagctgttggccggcgcgattaaggagcgcgtcgcggagctggggaagaaggttcccatcgcgatgatccgcaaggcgatcaacgagggctaccgcaactccgacttcaactacaaggaactgccgcattggtgcaacgacgtggtgtacgtcgacgccgaggaagagttctactacatggacaaccgcctcgcgctgagcgagcgtgcgttcaatgcgcgcaacaaccgtttcctgctgtcgaagaaagaccgctcgaacatggaagccgtgcctgagcaacaggccgccgcactcgcgctcaacgtgtaccaagttccggtcgtcagcggctacgtctacctgcccggcgcagaccgcatcgtcgagtgggacggccagaagcacgcgaacaagttcaacccggaagacatcgtgccggtgcccgacaagctgagcagcaaggcccggcgcgcagtcgaagccgtgaagcgtcacttcgagatttcgtaccccatcgagcgcgagcgcgaaatcctgctctcgtggctggcttacacgatcaagcgcatggacaagaaaatccgttgggcggttgtgatgcagggcgtggacggcgcaggcaagggcttcgtcggtgaaatgctcatggcgatcatgtcgcgcaacaacgtcgagaccgtcaacgctcaggcgctcgaagagaagtacacgtcgttcttcgagtcgcgcaaggtcgtggtgctcgaagaggcacgcatccacggtacgtcgcgctacgcggtgatggacaagctgaagcccttcatcacgaacgacgtggtttcgattcgccgcatgcaccgcgactcgtacaacgtgccgaacgtgacctcgacgatcatcttgaccaaccacagcgatgcgctgccggtgtacgacgccgaccgccgctacttcgtcatctcgacccacttccagacgaagcagatgatcgagaagttccgcgcgcgcaacccggatcactacgacgacatcttcaacgcaatcgcctaccacccgggcgcgatccgcgagtggctggaagactacccgctgcatcctgagttcgacccggacggccatgcgcccatgaccgacgcgaaggcgcgcatgatcgacctcgcgcgcggcgacgacgaagacgaaatcgaagagatgatcgcggagtcgcgcgacccggaagtgacgagcctgctgctcaacgtcgggaagctgcgtgacctcgcgatggacaacagtgtcggcgtgccgtacgggccgaagttgtcgaacttcctgacctcgaagggcttcgtgtacgtgggccgcgcgcgcggtgcgaatggaaagcaggcgcggtattggtcacgctcgccggatgtcgtcgtgcggccgaaccttcagcagtggatcgacgactacatcgaagtaacatcgctgaaggtgtgaacgaacaagcccgggcaaccgggctttttcacgtctgcgagcgtatgatcgaacacgctcaatcccgagcacaggagaaacgacatgacgactaccgtgaagttcacgcacgtcaacggcaacaaggcggtcgagttggtcgacggaaagggcgtggtgcatgcagtgctcgatgcgcccggccgctcggtcgaaatcacgatgcacggtgacttgcaggtcacagcgcgcgagaccggcgaattcttcggcgcgtcgaagccgcagggcatggtgccgaatgcgaccgtcgacgagaacaacaccgacgcgaaccgctacgagagcggcgaccttccgcccggtgccggcgacaacggctcgaacgtggaagacgagcgcgtcgaggatcgcaacccacgcaactcgatttaattcctcggaatttccgcaacaccggccccgggctcatcccccggggctttttattgcccgcgtggcggaaattcgactcatcccagcttgacatagtgcccgaccgaaacggatgcgaaaaattcggatttctaggtactgtcacatacggaaaaaattcctaccgtatggacggaaattcggaaaaaaggcaattcttgtgacagtacccgattttccatgctctccgaggcgcgaatcggtcactgtcacaaggtactgtcacaaattcaagtcattgatctacctactcttttccctattttgtgacagtagtgacagtagtgacagtaccttctctcatacgcgagaaatttttcttggaaggcagaaaaacttttctccggtaaaggaaaagaagtcactgtcacagtgtcactgagggggtctgacgcagtaaattcgcgcgcaaaaacgccttgttttcagccttttcaacggggggccgaaccatgtgacactactttgtgacactgaaaggtactgtcacaagcgaattaaatgcgcgcggggcggatattcggcaatttccgggcggcccgggggtcgattggagacggaaacgcaaaaattccgaaaaatgcgcgagcaccgaggtcagcgccccc

SEQ ID NO: 17 - DNA, 55589 bp, Unknown
  Bacteriophage Xfas107
ggctgggcctgacgtacaagaagttcctgttccgctggttcaagcaagagttcatgggtcgcaaggtcatcccgaagtcgcacgcgatggcgtcgattacgaagaagctcagcgacatcgtgtacaccctgcgcgaagaggattacgtcaagctgccgccgctccgctctacgcctgtgccgatcatcctgccgccggatgtgatggctcgctatcaggaattcgagcgtacgtctgtgctgaaatggggcgaagagcaagacccggccgtgcgtgcgctatcggaaggcgcgctgtacggaaagctgttgcagttcgcgtgcggtcgcatctacaccgacagcgagacgaaagagttcgtcgacatacacgacaagaagatcgagcgcttgaaggaaatcgtcgagttcagcgatggctcgccgatcctcgtcgcgcgcacttggcagcactctcgcgaccgcctgcgcgacgagttccccggcatccgttcgctgaagacgaagcgcgacctcgacgcatggaatgccggcgacatcgagatagcggagacgcaccctgcgagcatcggtcacggcacgaacatccagaagggcggtaacaacctcatctggtatgaccacacgcccgacctcgaactctacatgcagttgcgcaaacgactgcaccgacgcggccagactcgaagccacgtcaacatgatgcacctgacagcagtaggcactatcgaagaggatttgacacgcgagctggtcaagaaagaaattacccaagacgccctgagagaacccatgcggcgacgagtcgcagacgtacagagagaactagccaatggccgcacctaagatcgactacgaagaagagtttttcgacggcatgactgtgccgcgtttggcgcagttgttccgcctcgaccgccgcaccgtcactgagaagttgcgcccgctgcggccgaccggcgaccgtcgcggcgcaccgacgtaccacatcgtcgacgctgcgccctacctcgtggagcccatcgtcgacatcgccaagtacctcgcggaagtcggccccggcgacctgcccgcgccgctgcaagcgcaatactggaacgcgcagaacagcaagttgaagtacaaggaacagtcgggcgacttgtggcgcacgcagcaggtgctcgaagtgctgaccggcgtgttccgctcgctcacacagtcgcttcggctgttggccgaccgcatcgaagcgcagaccggcctcacgccggagcagcgcgcgatcatcgagcgtgaggtatccgacaaggccatcgacatgctgcgcaagcgcctcgtcgaagacttcgagatttacgtcggcatcaaggacaaggaacagctcgccgacatcaagctcgacgacatcggtctcgacgaagaggaagacgacgatgcttgacggtaatttcttcaacgacctcggcgagctggtcacgttcgttgccgatagcgttctggttccgccggagcgcttgaccgtttctcaggccgcagcgaagtaccgatacctcgacaacgagggttcgttcgtcggcgagtgggacaacgacgaaacgccgtacctcgtcgagccgatggacgtgctcacgagccgcgagttcgagtcgtgcatcttcgtaggcccggcgcagggcggcaagaccgaaatcatcctcaactggatcgcgtacacggcgaagtgcgacccggccgacttcttcctcatccagacagcgcgcgacactgcacgcgacttctcgtatcgccgcatcgacaagatgcaccgcgacagcaaggagctgggcgcgatgctgcggcccggcagcgacaacgacaacatcttcgacaagttctaccgcaacggcatgatgctgacgctgggctggccgacgatcaatcagctctccggcaagccggtgccgcgcgttgcgctgaccgactacgaccgcatgccacaggacgtggagaagaacggcccgccgttcccgctcgcgcgcaagcgcacgacgacgttcggttcgttcggcatgacgctggccgagtcgtcgccgtcgttcgacgtgaaagacccgaagtggaagttgccgcacccggactcgcatatgttcccgccgaccgatggcatcggtggcctgtacaacgaaggcgaccgtcgctgcttctactggcagtgccctcactgcggcgagtggttcgagccgaagttcgcgctgctgaagtgggacttcaagaatcccgatccgttcgaggctgctgcggcgacgatgatggcgtgcccgaagaacggatgcgtgatcgagccgaagcacaagtacgagatgaatcgtcgcggcgtgtggctgcgcgagggccagcgtctcgaccgcgacggcaaccgcctcggcgtcggtgtgcgttcgcgcagcgcgtcgttctggctgaaaggcccggcggcgcgcttcattacgtggcagacgcttgtcgagcgctacctgctcgcgcagcagacgctcgaacgcacaggcgaaacgaaggcgctgaaggccacggtcaacaccgatcaaggcgaagcgttctggccgctcaacgcgaaggactcgaaccgtctgccggaagacctgcaatcgaaggcgatccagtgggcggacaagaaggtgccgtacggtgcgcgcttcctgctcgcgaccgtcgacgtgcagaagagccgcttcgtcgtgcaggtcttcggcgtcggcccgagcgataacggcgtcaacttcgacctgtacctcgtcgaccgatttgacatccagaagtcgaagcggcaagacgatgccggcgatacgctgtgggtcaagccgtacgccgtgcaggaagattgggaactcatcaccgagcaggtcgtcgagcgcgagtacgagttggaagatggcagtggcttcatgtcgatcaagatggtcggcatcgactccggcggtaagtcaggttcgacgacgcgcgcgtacaactactggcgctcgatgcgcgacaaaggcgaaggcgctcgcgtgctgctcatcaagggcgagccgaagctcggtgcgccgcgtgccgaagtcgacttccctgactcggatcgtaaggatcgttcggccggtgctcgcggtgaaatcccggtgctgttcctcaactcgaacgtgctgaaggacatgctgctcggcatggtcgactacgacgagaagacgacgctcggcggtcgccacttcacgaacaagtggacacctgaagttgtgtatgccgaactcactgtcgagttccgcgatgaccgtggccgctggcagaacccgggcaagcgacgcaacgaagcgtgggacttgggctactactgcctcggcctgtgcgtcatcttgaaggtcgaaggattcgattgggactcgcccgaatcgtggtacgcggagtggagtaacaactctcttgtgcgccgtgtggatcaggaaaaacggtttgcgtcaagccccatcacggattatggtttcgccaagttcgggaaatccttgggatgagagatggcgactctagagcagttgcaagcatggctggcggaagcacaaaccgcctaccatagcgtcatgatcggcggcggcgtgaccgtcgtcgtcgaccagaacggggagcgggtcgagtacagccgagccaacgcaaccggcctcgccaaatacatagccactttgcaggcacagatcaattccctattgggggtcgcagtaacgggcggcccccttcgtccgttcttctgagggtaaaacgacatggcccgagcactcactgtcgttcgctcccccgagggcgacgaagcattcaacagcaccggcaaagagtcggccttcggcggtgcgtacgaaggcgcgtcgcgtctcaaccgacagaccgcgatgtggagcgcgccgtcgctgcccgccgacatggaaatctcgccggacaaggttcggctcgacgcgcgcactcgcgaactcgttcgcaacgacggctacatccaaggcgcgctcgacacgagcaccgactccatcgtcggcggccagtacatcctcaacgcgcgccccgattgggagacgttgggcctgagcgaagcgtgggccgaagagttccagctcatcgccgaacgcaagttcatgctgtacgccgaatcgccgatgaactggatcgacgcctcgcgcaagaacggactcacgggcctcgtgcgcatggcgctcggccagtccttcatgtcgggcgaagcgctcgccgctgcggagtggttgtcgaagtccggtcgtccgtacaagaccgcgatcaacatgatcgaccccgaccgcctgagcaacccgaacgacaacagcgataccgcctacatgcggcgcggcgttgaaatcgacaagttcggtgcggccgaggcgtaccacattcgtgacgcgcacccgatggagtcgtactacgaccgcttcggctcgaagtggacgcgcgtgccggcgttcaagccgtggggccgtccgcagatcatccacattgccgaagtgctgcgcccgggccagacgcgcggcgtgtcgaagatggtcgcggtgctgaaagaaatgcgcatgacgaaggtctacaaggacatcgttctgcaaaacgccgtcgtcaatgcgaccttcgctgctgcaatcgagtcggagctgccgcgcgagctggtgttctcgcagctcggtgccggcgacatgggctggttgcagaagtacatgggcgcgctggctgagtacgtcggttctgccgacaacctcgccatcgacggcgtgcgcattccgcacctgttcccgggcacgaagctcaacctgcaaaacgccggccagccgggcggcgtcggcagcggcttcgaggactcgctgctgcggcacatctgcgctgcgctgggcctgtcgtacgagcagttctcgaaggactactcgaagacgaactactcgtccgcacgcgcgtcgatgatcgagacgtggaagtacatgcagacgcgcaagaagctcgtcaccgaccgcttcgccacgctcatctacatgctgtggctcgaagaggaaatcaatcggccggacaccgatcttccgctgccgaagggcgctgcgcacttctatcagggcatcaaccgcgaggcgtattgccgttgcgactggatcggcgcgtcgcgcggccagatcgacgagctgaaggaaacgcaggcggccgtgctgcgcatcgcgtcgggcctgtcgacctacgaagaagaactcggcaagctcggcaaggactaccgcgaagtgttcactcagcgcgctcgcgagatgggcctcatcgagaagaagaagctcaacttcacgctcagcaccagcaagccgggcacgcagaaagaaactgacagccgtgcgtcgaacaacgccgatgacacgggcaccgataccgacaccgacacggagaacgacgatgaatgaactgctcgcaatgcgcatggcgcttgtcgagggattcaacggccgcccggcgttgatcgaccctcgcgatgtcgagaaggtcgcaacgctgtgcatgacgatggcgcaggcgaccgtcccgccgagcgccgagcagcgcgcgcaggcgcaggaaggcatcaccgcagcggtcgaatccgcgttcgacgtgtcgttcccgcgtgatcgcgccaagccgttcctcttcagcaacggcctcgccttcattccgatgcgcggcacgctcgtgcatcgcaacggcgacccgtggtacggcacgcgcggctacgacgacattcgccgcgagttcgacgccgcgcaggctgacccggacgtggcgggcatcgtgttcgacatccactcgggcggcggcatggtgtacggcaacttcgagctggccgagcacatccgcaagggccgcgacacgaagccgtcgctgtccgtcgtcaacgcaggcgcgatgtcgggcgcgtactcgctcggcagttccgcgcagcgcatggtgtcgacgccttcgggcgacagcggcagcatcggcgtgctgacgatgcacgtcgacatgagcaaggcgctggaaaagttcggcgtcgccatctccctcatccatgccggcgaacacaaggtcgacggcaaccccttcagcccgcttcccgacaacgtgcgtgcagacatgcaggcgcgtctcgacggcatgtggcagaagttcatctccgtggttgcgatcaatcgcgggatgtccgaacaagcggttcgtgacacgcaagcccgtgtgtatcaggcggacgatgcggtcaaaatcggcttggtcgatgcggtgatgtctccacaggatgccatcgctaccttccgggccgaagtcttcggctcttccaccaacgataggagtgacaccatgagcgacacgaagaagaccgatgccaccgtcgagcagaagaaggccgacgagcaggtcgaaaacaagaccaccgacaccaccgtcgacgcgggcaagaagcaggacgagcaggtcgatgccggcgcggccatgcaggcgcgttgcgcggcgatcaccggctgcgaggaagccaagggccgcgaggcgctggcgaaccacatcgcgttcaagaccacgatgtcggtcgacgaagcgaagtcgatgctgtcggcctcgccgaagcaggccaatgcgtcgtccgcactggacgcggccatgtcgaactccggcggcggcgcggacatcgccaacaacggcggcgacgaagaagagcaggcgcgcggcaacgacgatggcggcctgctgggtgcgtacaccgctgccaccggcaacaagagcgtgcttcgcgtcgtcaagtaatatcggcacaccgtcgccagcctagacgggaaaaatccggctaaccgtcaatcacagaaggagtaacgaaatgaccaacttcggccccatcgctggctacgtggctcgtaccgacacgaacagcatccagctctatgccggcgaagccgacatcgtgagcacgcagggcgcactcgtcaccggcgtcgcgtacgtcggcggtcaggttctcggccgcgtcaccgcgtccggcctgttcgccaagcacgatccggccgcgaccgatggcagcgagaacgccatcgcgatcctcgcgtacgacgtggcgaccccgaccgccggcaagaaggaagcgatctacgtcggtggcgtgttcaacatggaagcgctgaccttcaacgccgcgaccaacaccgacgccctgaaggccgccgcgttcgacggcaccaacatcgtcgcgcagaagctctacggcaacccgccggccggttccggcccggtctaagccggcatcaccaacagcaagacgtttcgcaactacacaccgaaatagaaggagacaacgatggatttgttcagcactgcggaactgcgcaaggtgatcgtcgacagccgggcacccgtgcagtatttcctcaaccgtctgtacaaggagcagatcaacttcacgaccgaagaaatcatgttcgacgagctgaagctcggccggcgcatggctccgttcgtggctcccaacgtgcagggtcgagtcctgaagcgttccggcttctacaccaagtcgttccgtccggcctacgtcaagccgaaggacgccgttaccccgggccgcatgctgcgccgcctcgcgggtgaagcactgaccggcgacatgacgcccggccagcgctggcgtgccgtggtggccgcgtaccagctcgaccagcgcaaccagatttaccgccgctgggagtggctgggcgcgcaggctgcgctctacggtcaggtcacgatttcgggcgaggattacccgaccgtcaccatcgacttcggccgcgccgccaaccacaccgtcatcctgaccggcaccgcgctgtggacggaccagacgaacagcgacccggacgacgacctcgaagagtgggccgctcgtgtgcatgacgccgaaggtttcgtcgtcacgcgcgtcacgatgggccgcctcgcgtggaaggcgttcaagaagcacccggtcatcaaggagctgctggaaacccggcgcggctcgaagtccgaagccgaaaccggcccgggcctcggcgagtcggtggagttcaagggccagatcggctcgttcaacatctacgtctacaacgacgtgtacgaggacgagaccggcacgatgcagccgatgatggacccgcgcgacgtgctgctcgaagccgaggctggcttcgacggcgtgcgtgccttcggcgcgatcatggatgcggacgccgatcttcaggcgctcgacatcttcccgaagatgtggaagaacccggacccgtccgtgatctacctcatgtcgcagtcggctccgctcatgatcccgagccgtccgaactgcacgctgcgggctcgcgtcgtcgcgtaagcaacgtcgcacacggcaagcccggttcgccgggcttcgctgtagcaacacaactccccaaccgaaagaaggagcatcaagatggcgaagtacaagttcgtggcccgcgtggcgctgaagggcgatttcgacgccgaagacggcctcggcaccgcgttgcaggaagtgcaggcgggcaccaaggccggcaccgacgacaagaagctctacgactcgctgctggaacagggctacatcaagtccgcgaaggacgccgcgaaggaagaggacgaggctccggctgcgtcgtcgaacccgagcaccgcgccgaaggtcgagtcgaccgacagtacggccaagagcggcggcaagcagggcgcgggcaagtaagcccggcgcgctgaagggagaacggaatgggctggctcgaaaccaagcagaaggctcggcaaaccgtgcatagcacgtttggtctgccggcccaatttcgcccgaagtcgggcggtgctgtcgtcgacggcaccgctcggctgcactacaaggttcgcacgttcggcgacttggaccgcgaaggcttcgcgaccgtcaccgaagcggtggactacatcatcatcgacacccggattttcgtgggcgctgacgaaggcgaccgcgtgttcttcccgcagctcaatcgtgcgttcaagctcgatgtgcgcggtgaagcggaagacgacattttcatcaagtgggaagtgactgaggtagcgccgtgaccgtcgagattggcttccgtggattggacgacgtgcgcaagcgcgttgccgggataccggaaacggtagaccgggcttccgcgttcgcgatcaacgaagcagtcacgttcggtcaggccgagagcagccgccgcattcgcgagcaggttgcattcaaggcgagctacatcggcacgtccgacaacccgaacgctcgactgcgcgtgtcgaagaaggcgcgcgtcggcgacctcgaaggcgtcattgccggccgcatgcgcccgacttcgctcgcgcagttcatgaccggcgcgaagctcggcaagggcggctacgcgcgcgtcaaggtctcggcggctggcgcagcgcggcgcatcccgaatgcgttcccgatgaagctgcgtcgcggtactggcgtatacgacccggagaacgcgaacgtcggcctcgccgtgcggttgcaggacgggaagctgccgggcggcatgaacaagaagcagatggtgcaggtcagcggcaatctctacctgctgtacggcccgtctgtcgatcaagtttttcgcgatgttcgattcgatgtgcaagggccagtcggcgacgtgctcgaatcgagcttcctgcgcaactacgggagactgagccgtggctgatacgaaacgactgctgctgctgaaggcaatctgcaatcacctgaagaccgaaatcacaacggcgaatggctacaacttcgacctcgcttcggtgtaccggggcaagaagaacttcggcaaggaagtgaagctgccggcgctcgtggtgttggagaacttcaacccggatcgtctgccggaaaccatcggcggcgtcgtcggcaccaagcacaagtacgaccagatttacctcttgaacggatgggccgaaggcggcgatgtcgagcaggaagaagactcggcgcatctgctcatgggggacgtgaaaaaagcgctcggcaagctgctggtgccgcgcaaccaaagcgggttcttcgatggtctcgcaaacacgctgtccatcgagcccggggttgttcgccctcccgacgagcaatccgaaaaggcgtatttctggatgaggattcgtctggaagtcgtcgaaaaggtgggagacccgtactggattcgtgattaaccgttgtatcgacagaaggagaccgtaaatgggcagcgagaattacacccttggccgtggcgaactgcatttcgacaagttcgcaccgggcacgttcaacaagaccggcgagcgctacctcggcaacacgccggagttgaaccgcaccaccgagagcgaaaacctcgatcacttcaacagtgaccgtggcattcgcgtcaaggacaagagcatcgtgctcgaaaagaacgacagcggcacgttcatcgccgacgaaatcagcgacgagaacatcgcgctgtggttcctcggtacgcagaacgtggtcgcgcagtcggcgaccgccagcgtggtgcagaacatcccggccaaccgcgtcaagccgggcacctacatccagctcggcgagtcgcaggccaacccgaccggccatcgcaacgtgaccctgaccagcgtcaccagcgatccggtcggcacgaccttcgacaacctgaccgactacaccgtcgaccccgagctgggccggctgtacatcgtgccgggcggggccatcgacgggaccgagccgctgatcgtgacctacgccaccgccgcgtcgacccggacgcagatcgtggtgggcgagggcacgaccatcgaaggcgcgctgcgcttcatctcgtacaacccgaccgggccgcgccgcgactactactggccgtacgtgcagctccgggccgatggcgacttcgcgatgaagggcgacgaatggcagcagctttcgttcgcattcgacatcctgaagcgggacggctacgcttccgagtacatcgacggtcgcccgaccgccgcgtaaccggggatcgtcaaacgcggtcaaggccaacttagtcaagaccaagcgagccaagaccaacttgacaggccgcctcgggtacccccggggcggcctgtctcataaccaccagaggaaaaacgcatgtcccttgccaacctgcaactccgcactgcaaccgttccgtatgtcggcgcgaacgatgagcagcacgacatcgtgctgcacggcctcagcgccaacgccatcgccggtctcatcctgtcgcagctcagcaacatcgaagaaatcttcaacatcgtcgaaggtgccggcgtcaagaaagccgaagacctcgcgaacgtcaacatcgtcgaagtcggtcagcggcttctcgtgcagctccccgatttcatcgcgcacgtcatcgcgtactccgcgcacgagccggagcagtggagcaaggtgatgcacctgcctgcgcccgtgcaggtcgattgcttgaataagctcgcgaagctcacgttccaagacgaggccggcttccgagaattcgtgggaaacgtggtcgcggcactgcgaagcgcaaaaggcgtagtgccgcagaacagcaaccgaaatctcgccgccagcgcttcgccgaatggtggctcggcatccgcgcagccgtctctttcctgacggctgaaggtcactcgaacgctggcgaatatccgctcgggtatttgatcgtcgaatcggaaatcgcacgcgagcgggtgaacaacagaatcagaaccgaaatgacgctgacgcagagtgctatcgcctcggcgctcagcaagaaagcagcatcggcattcaaagaaaacatcgaaggactataggcgatggccgctcagaacgaagttgaactgattgtacgtgcgaagaacctcagcacgcgaaccatcaaccagctcaacgacgagctgagcaagatcgcagataaccaagagcaagtagccgatgcgaaccgactggcggagcggtcgttcgagagcctgaagtccgagcagcagcagttgctcgcgatcatgaagtctctcaacgaccgcgcttccaagctcgatgcgtactcgcggcaggagcagcaagtccgcagtctgcgcgacgagctgagccgcgcacgcgacaacctcaacacgctcgcgcaggagttctacaagacggagaagccgtcgaaggaattcacgcagcagttgaagacggccgccagcgaagtgacgaggttggaatcgtcgctgcgcaacaacgagcgccgtctggaaaccactggcacgaagctgcgcgacatgggcgtggatgtcacgcgcttctcgcagtcgcaggccgaagtcaatcaggcgctcaatagctcggtcgcgctgtataagcgctcgaccgacaacgtggagcgctacgacgccgccgtcaaggaagtgcgcacgacgcagcagcaggcccgcgaggctgagcgcgccgccgcgcaggaagcccgcgactcggcggcgaagctggaacaggccgcccgcgagcgcgaagaccagatgcgccgcgagcagaagatggccgagctgacggccaacgtctaccgcacgctggcccgggagaaagaaaaggcggctcaggccggggcgcagttccgcgcgggcggcacgcaggcgctcgctgcggcccgcgcggcggctgtccctgccgtgggtagcgggtcggccgcgagcggggctgctgcgggcgtacaggcgcttctcgacccggccaaggatgcggtcgcgacgctcgaccggctggaaaaggccgtcgaccagctcgacgaggaattcaaggcgctcacgccggacgccctgcaagccgctgacggcatcgacaagctggccgatcaaagccgccggctgcgcgctgccgccgatgcgctgaaggggcaggccgggctcgccgacgaattgaaccgccagaacaccgcgctgctcgcgagccaacagcggttcgaggaagcgcggcaagaagtgatccagtacgcgcaggcggtcgagcgcgccgacaagccgaacgacgaactggcggcgtcgttgcagcgcgcgcagaacgagatgaagcaggcgcacggcgaactgacgcgccagaccgaagcgttcaaccgtgtgcagcagcgcgccgctgccgccggcatcacgctcaacaacctgaccggcatcgagcagcgtctcgctcaggccgcgacgcgcgtgcgcaccgggcaggagcaggtcgcgcagacgatgacgcggttggagcagacgaccgcgaagaccaacacgcagttgaagctcttcaacgacggtcagcgtaccgcgctgtcgctgtatcagcgcacccgtggtcaggtgctctcgctggtctccgcgtatgtcggcgtgttcggtgcgctgaacctcgtcaacagcgcgatggatgcggcactggaacgcgagcgcgtcatgtcgcgtctgctcatcgcgaacaagggcaaccagactgcggcggcggaagaatacgactacctacgcaagaaggccgacgagctgggcgctgcgttcgggccgctgtccgagtcgtactcgcgcttcgccgtcgctgcacgcgacgcaggcatgagcaccgaggcgacgcgctacatcttcgaggcgttcaccgaagctgcgaccgcgatgcggttgagcggcgacgaaacggccggcgcgttccgtgcgttggagcaaatcttctcaaagggcttcatccaagcggaagagctgcgtggtcagttgggcgaccgcatgactggcgcgttcaacctgttcgcgaaggccatcggcgtcacgacgcaagagttgaacaacatgctcgaaaagggcggcgaagtgaaagcagagttcgtgctgctcgccgcacagactgcccgtggcatctacggcccgcaggcgaaggctgcgtcgaatagtttgctcggcgacctcaaccgcatgcagaacgcatggggcgatctgaagcgcgaaatcatcgacggcggcctcggcgatgcgctgcgtcgtttgttcgtcgacctgacgaagtacctgaagagcgacgacggcaagaagttcgcggagaacttgacgaaggtgttcgtcgctgcggccgacgctggcggcgaactgctgaaggtgctcgcggagaacgacgaaatcatcaagctggtggcggacaccgttgcgttcctcatcaagaacttcaaggcgctgctggcgatcatgctggcgattcagggcgcgcgcatcgcaatggtgttcacgtcgctcgcaacggaaatcctgaaggcgcgtgcggcgacgctcgcgctgaacactgcgctcggtgccggcactgcggcgtcggcgggtcgcgcgggtgtcgcgctgggcggcctcatctccgggccgattgccgcgatcctcgccatcgcggctgcgggcatcatcatcccgatctatttccagatgaagggcgagctggaatcgaacaaggtcaaggtcgacgcgcagaagacgatcaacgacttgaaccgtgggttcgaggtctcgcagcgcagcctgtccgacacgtcgaagaccaacgccgaacaactcgaacgtcaggtcacggcggcgtcgcggctgctcgaaatctacgacaagcagaaggagtcgctgcaagcgcagattcgcgagaacacggccgtacgccgaaaccaagtggcggttcgcgttgcgcagggtacgcgcgagcacgacatgaatttcccggccaagcagctcgccgctgtgcgggaagtcgagaacgaaggcaaggcactggaagcacagctcgccgcactcgaacagcgtgccgctccgcttcgccagcaagtcgctgccgccagccggcagatcggcgagacgaaagcacgcgaggcggctgcggagaacgacgcgcttgcggctgagttcaagcgcattcaagcggcggccgatgccgctgctgcgcgtgctggcaccgacgcaaaggcggcgaaggcggctgaggctgcgcgcaagaaggccgaggctgaagagaagcgtctggccgcgctcgccgagcgccggctgcgtctggaagaggacgtagcggagaagctgcgcgacatcgacaacgacatcgccaactcgcgcccggatacgctcgaagcgcggctggctgtgatcgacaacaagatcgcggatcgcaaggctgaactggaacgcatgctgcgcgaagccgacaagctcggtcagtcggatgcggccaagggcgagattcagcgaggcatcaattcgctgcctgagttgcagaaggcacagcagcaggcgacgacgcaggagttctacgagcagcggatcaacgacctgttgcaacagcggcagtcgtcgatggatgcgatcaacaccttgcaagaggccggactgctgacgaccaccgaagccgcaacccggatcgaggaagtcaacgcgcgtcttctgccgcagctcgaagcgttgcgcgcgaaggccgccgagttcatggcgacgctgggggacggcccgcaggcgcaggccgcgcgcgcaagcctcgaaaacctgagcgcgcagattcaggcgatgtcggtcgaactcagcgcgcagaagcgacaggtgatcgacgtgttcgtcaacggcttcggtcaggcgttcatggagaccgcgaccctcatctccgacacgctgaagggcgtgcaggatgccggcgacgcatggaaggcattcggcgacatcgtgctcaacaccatcgccgacatcctcatccagctcgcgcagatgattattcagcaggcgattttcaacgcgctgaaggcggcggccgagaacagcggcggcggctggggccagattatcagcgcggtcgcgagctacctgcacgttggcggcctcgctggttccggctccggccgtcgttcgtcggtgccggcgtacgtgttcgaggctgcgccgcgctaccacacgggcggcgttgcgggcctcgcgcccgacgaagtgccggcggtgctgaagcgcaacgaggaagtgctgaccgaagacgatccgcgccaccgctttaacggcggaatggcaggcggcgctcagcctgcgatggacgtgtccatcattaacaccatcgacagcgagagcgtggtcgctgccggcgcgaacacccgcgcaggacgccagtccatcttcaacgcaatcaaagctgaccgcagctcgtacaagaaacttctcgcataaggaatcgacatgggacacgtaattgcaactgtgactggcggcagcggcgacgaggcgcactacaaggtgctcgctgcgatcaagacgctcgctgaggcgaacgggtggacgacgctgcgctacgtcaacaccgggaccgtgcgcgagttgatcctcaactcgtccggcctgtcgggcaccgaagacatctacatcggcttccgcacctacagcagcgtgagcggcgactactacaacatgctcgtcggcacgtttaccggctacgtctccgcgaactcgttcgactcgcagccgggcgcgaagctgagtggtgtgccttgccacaacaacgcggtgacgtacttcatcactgcgaacgcgcaacgcatcgcgggctgcttcaaggtcggcactccggtctacacccacttctacgcaggcaagatgtttccctactcgcgtccgggcgagttcccgtcgccgctggtgtgtgccggcatgttcgacggtgcagcaccgaagcgtttcagcgacaccgactaccgcttcccgtatcacggccgcgagtcgggctatacgggcggctcttcgtcgaacgtgcgtccgtcgtacctgtggctgcgcgatcaagcaggtacgtggcgtcggctgtcgcacttcccgttctacaacggcccggccggcagcgatgcgtcgagcgcctacaacgcgctcgaaaactggaactacttgaccggcggcgaccaaagccgttcgctcgttccggccggcacgaattaccagccgcagccgatcatcctgtacaccacgagcgcgccggccggcgtgtgggaaggtgcggtgtacggcgagctggacggcgtgtacgccgtgtccggcttcaacaacaacgtcgagaacgtgttgcaggtcggcggcacctacgtcgacccggcgggcctgagcatcgccgatcacgtcgcggacattctcactgccggcgggcgtgcgttcgtcgtgttgcaggacgtgaatcaaactgactggcgcagctttatcgcattggagatgacctaatggcttactacaccggcaacttttcctcgttcgcatcgctgaagaattcggtcgagaccgcacttcaggcaaacggctgggggctcaacggcgacggcgtgctggaaaagaacggcatgtacctgcgcctcactgcgactgctgcacaactgctgttgcaggccggcaccggaagcgcaaccggcgcgctgcccggcgctgcgccgaacggcgtcaagatcatggacttcgagggttcgccgatgaatttcccggcgacttacgacctgcacatcaacgtcggcccggacgaagtgttcctcgtggtcaactacaacgccgacaagtaccagcagctctcgtggggcaagtcgaacatccagcagatcggcggcaccggcatgtggttctcgggctcgttcaacgagaacgccgcgtcgaaccagaaccagctcgtgtacaccagcgccgacgcgagctacttcggcttcggcttcggttggtcgggcatgggctgcggcctgttcgccgagtattacacgcaggcgctcggttgctcctacatccacaccggcctcgattcgactgcgtggcgtcgcgtctacaacggtgacggcaacctcgtcggttccggcgatgtcgttgcgggcctgctgcaagcgttgccgtcgatgttcaaccagaacacggtgctgctgccgctgctggtcacgcagcgtcgtctctcgcagggtcagactatcgttgccgacatggtgaacgcacgtctgtgccgcaacgacaaccacctgtccggggaaatcgtcacctacggcaccgaccgctggaaggtgtacccgttccaccgcaagaacgccgacgtgcgcaacggcgtctcgtggtcgacgggcgcgaaccactccggcactttcgcctacgcgatccgctacacggggccgtaactcatggcaggcatcaccggacaattcagcagcgaagtcgagcgcggcatcaacaacgcgatgctgagcgaggacttggacgacaacaccgaagtcgtctcgatgttcgacttttacgaaatgcgcccgggccttcaaggcggctacgggcgctggcgcgtgcatgccgacaaccattggggcgtcaccggccagcgcaagtcgaccagcttcttcgacgactactacaaccgcatctacatcgtgccggccgcactcgacgccggcaatttgctgtcgacgcaggtacgccacatcatcctgtggaatgcgtacgtcacgccgcagacgttggaaaacgccgcgctcggcccgcaggcaggcatctcgatgtcgctgccggtcggcgtgagtctgccgtacgagatggagccgctgcgcgagctggacttcaccgtgcagatcgaactcagtggcccgccgactatcgacagctatgcgaacttcactgtcgagggcattacctacaccgtgccgatcaccggccgacgcatcgtgctgttcccgttcgcgccgaattggggctcgcctgtcgacgagacggtcacgatgcgctcgtgggttctggccgccgaggatggcagcgagcagaccggcagcgagtcgggcgaagtgccgcgccgcacgctcgaatacaacatcaacctgcgcacggcgttgcaggcgcagcgatgcgagaacctgctgttcgcgtggcagtcgcgcttcttcggcgtgccgcattggggcgaggaagagcgcatcgacgcagacgtggcggccggcgctacgacgattccgttcgacaccttcggcctgtcgctcgaacccggctcgctggtcgcgctgtacctcgacgacgagacgaacgaaatccgcgaagtgcagacggtcggcgtcgacggcattacggtcacgaccgggttgcaatacgactggccggaaggctcgcgcatctatccgtgcttcgtcgggctcatgaacgatgcgatgagcggatcgcgcgaaacgtcgacggtgggccgaatgccggtcgcgttcgactgcgaaccgagcgtgaccccgggcaacgtcgcgctcaacatcgcgccgttgacctaccggggcaaggagctgtttctcggtcgcatcaactggcagtcggctatgcccttcaccttcacgtcggatgtcaagcgcgtcgactcgaacaccggcaagttcgtcgcgttctcgtcggcaggcttctcgaagatgtcgcgccggcacaactggacgctgttcaaccgtggcgacatcttctcgttccggcagttcctcggccgccggcagggcgtcgcgcgttcggtgttcatgccgagcggcacggtcgacttcaacatggccgcgccgatcctcgacaccgaagacatcctcgtggtcgagaacaacgaatacggcgcgctggccggcgcacacccggcacgccgcgacatcatcatcgagctgcacgacggcacgtatttctgccgccgcattctcggcaccagcgacttcgacaacttcacccggctgcaactcgattcgtcgctgggcgtctcgctcgatgtcgacgacgtggcgcgtatcagcttcctcacgctgtaccgcttcgagtcgccgtccaccaccatccgccacctgaccgactcgaaggctacggtagaagccatcatggtcgcgaagacgaccgaggattgacatgagcctcttgcaatacgaaagcgacaaggaactcagctcccgcgtggagctgtacttgttcgagagcgacgatggccgctatcgctgggcctacacgaccgatgcgcgcgaaaaggtgctcggccccatcgtgtacaagcccgagtcgatcaagcgcggcgagctgaagcagacggccggcgacgcgaatatcgagaacctgcaagtcacgatgccgttcgacaacccggtggcactggcgcatgtgccgtacctgccggcgcggccgatcaagctgacgatctacgcctaccagcgcaacgaccctgctgcggaaatcgtgcaggcattcaccggccacatcaccagcttcaaccagaagggcgctgaggccacgctcgaatgctcgcagatcatcgacaacctctcgcagacggtcccgtgggcggtgttcaagagcggctgcatttggggcttgtaccaagtcggctgcggcgtcgacaagcagttgtggaagaacgatgcgctggtcacgaccgtcaacggtgcggtgctgggctcgcctgagttctcggccaagccgaccggctggtacaccaacggcttcgcctacaacccggcaaccggcgaacaacgcttcatcgttgcgcacgacgccgccgccggcacgatcacgctggtgtatccgttcctcgaaattaacgggagccagatcatcgaggtttacgccggctgcgcacgcacgaaggaagtgtgcgcggacaagttcaacaacaagctcaactacgtcgggttcgatcacttcccggcctacaacgtcttctcgcaggggatcacctaatggtttgggtagccatcgtagttgcgctcgtcatggctgtagttggcgagctgcttcggccgaagccgaaattcaacgacccgaagccttctgctgtcggcgacttctcgttcccgactgcggatgcctcgcgcgtcattccgatcttcttcggcacctgcaagatgcaaggtccgaacgtcgtgtggttcggcgacctgacgatcatcacgctgaagaagaaggtcaagaccggctggttctcgtcgaagcgcatcgtcaccgggtacaactactacctcggcgtgcagctcgtgttcgcctacgggccgtgcgacgagttcatcgaactgcgtatcgacgacaaggttgcgccgatcaacaacaagacgttcacgggagacgtgtgcgccttcacgatcaacgcgccgacgattatcagcaacgacgacccgccgaacggcgtcaagggcaactgcaagctgtatcgcggcaccttcgagcagccgccgaatatgtacctgagcgagcagtgggacgagccggagatgaccgcgttccgtccgctgctgcacatggtcatggagaagtgctacctcggcaacaccgacacgccgccgcccatctcgatcatcacgcgccgctgcccgaaccagctcggcttgactggcggccggcacaacgtcaacggcgactcgaacatcgcgtgcgccgtgtacgaggtcatgaccaacaatatgtggggcatgaaaatccccgaagacaagatcgacgtggattcgttcatcgcctgcggcaacacgctggccgacgagagcatcggcatctcgatgctggtgcagaccgccatgctcggccgcgacctcgtggcggaaatgctgcggcacgctgacggcgtggtgtacgccgacccggtgacgggcctgtacacgatgacgctggcccgcgagattcccgacgaagagcaagacgagctgctgattgtcgacgactcgaacatcctgccggatacgttcgagttctcgcgttcgtcgtgggagatgacgaagaacacgatcatcgtgcagtacaccgaccgcaccacgttcgagacgacgccggtccaataccaagacctcgcgaatatcgacgtgcgcgggggcatgatcgactcggaagaattcagctacctcggcttcagcaactcgaccgccgcgatgaacaccgctgctcgcgtgtcgaagatgaaggcgtcgccgttggtgtcggcgaagatgtcgctcaaccgcatcggctaccagctccgtcccggttctgcgttctggctccgcaagccgaaccgtggactggcgaacgtgctcatgcgcgtcatcgaaatcaactacggcacgctggacgacccggccatcaagatcacggcgatggaagacatcttcgcggtcaatgccgtggcctacgttccgccggacccgagcgattggcaaccgccggttggcgcggtcgtgccgttcacgcagcagcgcatcatcgaagcgccggcattcggtgccgaggatatgtcgcggcgctacgtcatcacgatgggtgtgccgaacagcaacggcgtgatcggctacgacgtgtggaccgacaccagcggcggcacgaacttccagcagacgaacgccatcgacgcgctcacgccttcgggcgtgctggtgtcgggtttgtcgcgcaccgggccggaagtcgatgctgcgggcttcaccgtcacgtcggtcgtcggagtggctgacatcgaagcgggcactgcgggctcgcgcgagtcgggcgaaaacctgctgctggtcggcaacgaactcatggcatggcagggaatcacaaacaacggcaacggcacttacacgatcacaggcgtgtatcgcggcgtgctcgacaccatgccgcaggatcacggttccggttcgcgcgtctacttcatgtcggaaggcgcgggcacgaccaacgaagacggctacggcggcgacctgacgctcaacacgaagctgacgccgaagagcatcatcgacacggtgccgctggacaacgctgcggcgatgtcggtcacgaccaatgctcgtgcgctgcgtccgctgccgccgggccgcttgcgcatcaacggcgcggtcgtgggctcgggtgctgcatacacggccgacatgatgttctcgtgggcgcaccgcaatcgtctcgacgacagcattgcatcgcaggccgataccagccgtacgcccgaggaaggtacaacctacaacatccgggtctacaccagctcgaacgcgctgctggcgtctgcgctggacgtgtcgagcgcagcatcgaccggcaccatgcgcttcgcggtgtcgggcgatatgcgcgttgaaatcgaggcggttcgggacggctatgtgtcgtggacgaagctggtcggctacttcagctatactccggccgccggggctaccgccaacgaaatcatcgtcgacgaacccgagtacgttctggacgggggtggcgcgtaatggcacaggtagtcgttgcacaacgcatgtggcagcgccgcgacactgcggcgaattggtctgccaagaatccgatcctcgcggccggcgagattggcgtgcagctcggcgctacttcggacgagaccaagttcaagatcggcgacggcgcgaccccgtggaactcgctgtcgttcttcgagggccggctcatcgaaatcggcacgggcggcggttacatccgctggcgctacgtgggcgacgccgactggatcaatctggtctcgctcgaatcactgcgcggcccggctggtgcgaatggcgcgcaaggcccgcaagggttgagtgcatatcaggtcgccgtcgccaacgggttcgccggcacgcaggccgaatggctcgcatcgctgaaaggcgagaagggcgatcaaggcgaccaaggcccgcccggcattccgtcgcagcgtcgtatccagcgcatcacgaataccgacagcggctccatcgtgtgcgactggaactcctacgacgaaatccgcgtgacgctgaccgccgacacgctcgtcaacatgacgggtgcgcttgacggtcagggctgcgtgctgctgctgaagcaaggcggcgtcggcggtcacggcgtttcgttcggcagtaacgtgcgcttcaacaacctcatcccgatctacaacccgacaacgactgccggcaagtccgacaggctcggtttcgtctacgacgacgacgcgggcttctacgacgtgcaagcaatcgtggatggaatctaacgatggcagacgactacatcccgccgttgtcgccgaacatcgtgtgggtcttcaagggcaacgactacacgcccccgttgaccccgaacatcgaatggatattcggtgcagatgatgaaggcggcggaaacgagctacgcaaatccacctacatgctaatcctgacaatgtgaggtattgaaatgactgttcgcatctactcttcttccgacgctggcgctccggttctgcgcggcaacacgccgggcgacctcatcaacgtgctcgaaaagtgcctcgtcaccggctacggctcgaaagccggcgcaggctggacgaagccgtttaccggcacgaacgtcgcggcgttccagcaaggcgcaggatcgaacggcatgttcctgcgcatcgacgacaccagcactgcgaccagctaccgcgcagcgttcatgaaagcgtacgaagcaatgagcgatgtcaacaccggcacgccgacttcgttcccgacgccgacgcagaaggcgaatggcctgccgtggttcacgcactacagcagcggttcggtcgccaatccgcgcccgtggcgcatcatcgcggacgagatgctgttctacttcatggtgaacacctacccggagaacggcgacagcggttactactacaacgagtgctatgcgttcggcgacatcatcccgttcaagccgggcgacacgacgcacaccatcttgctcgggtcgtggaacgacagcagcccgaatacgtctgaaggctatccgttctacggcgtcggtatcagcagcacgatgggttcgagccgctacgtgatgctggccgcgcgctcctacacgaatctcggcggcccgatttacctcggctggcacaacgacatgaccaagggcagcaacacttggggcgtcggcaatttgtcctacccgcacggcccggacggcggcctgtacttgtccccggtgtgggtgcatgagccgcaggtttcgccgtacaacgtgcgcgggctcatgcccggcctgtgggtgccgtgtcacaacgagaacatcttcagccaagggcagaccttcaacggtcaaggcgagctggcgggcaagacgttcatggcgcgcaggcactaccaatgcactgcggtcttcgagatttccgacacttgggataggtaacgcgcgatggcgctcatcttcaacctgccgatgtcggggccggatggctccacgacgattaccgacaccacgggaaacttctcgtggtcggtgaacggcaacgcgcagattcaatccaacgcgctgctgctagacggcagcgacgactacgtgagcgcgcctgtcgatagccgggtgaagatcggcgctatcagtaatttccgcattgccttcgacatgcgcatggcggcagcggacaagggcggctacaggatcatcctcgaccagatcaacacgtctatcagcgcatggacttggcaggtctacacgcaagacggggtgcttgcgtggagcgtgtacaacccgagctacggcggcatcaatcttgtcggcggcactgtggatgttgcggacggcaactggcacaccgtcgaaattattcgcgagagcggagccgtcagaattgttcttgacggcgtgacgcttgcgacaggaagtgacggccgagactacgcggttacgccgatcataggtatcggaacgcgcgtctaccagcggtatccgtacgactacaaaggttcgctgcgaaacgtctcgctggaaatcaccgagccggttgtctcgtacggccgggtttccgcgttcgtagctaagtcgctggtcggctgggatcgtgcgcgcaatcgttcggcgatccgccggagcatcttctattcgttcccgcctatggaaacgaagaaagtgcagacggtcaaggtcacgcgcggcgtgccgccgtggtgggggccgagcgggtcgaccacgcagctcccaacctacaagctgcgcggccgagtgatgcagcgcgatcctgacggggtgttgccggatgcgccggtacagtacgcgcgcgtcgtgctgttcttcaggcgcttgcatacgctcgtagacatccagctctccgatgtcgacggctacgtgcaattcgataacctcatgccgggcggtcaggcgtactacgccatcgcgttcgacccggaaggcgcaccgttgcagaacgcggtcatttgggatcgactgacacccgagcccgggccgtaaggagaagtgccgtgagcccgaacaacaacgagcagaataggaaccgaagagtgacggacaaagcagggggacttctggacgccgcgcaacaggccattcggctcgaacgcatcgaaggcgatatgcgtctgctcacgcagcgcgtcagctccggcatggagaacgtaagcgccacgctcgcggccgtacaggtcgaagtgcgcggctgctcgacgaacgtgtcggagctacgcggtctgcaaggcgcgcacgactcgaacaaggtagcaatcgacaaggtggagaaatcagtgtcggaacttggtgcgaggttggagtcgtggttcgatgagttcgaggccaagcaggaacaacggtggcgcgactactcgaacaaccgcgatcaatggcggcgcgagcacgaagccgagaacgaaaacgtcaagaaggacttggagaaggaaatccgcagcgtgcgcgagaccgtcatccgcttcgtcgggttcggttccgcaatcggcgcattggcgggcgtgatcgttggcggcttcctgtggaacatcaactaccgcttcaacgacaacaaagaggacacggatcgagtcgagaagtcgtcggcctacaaccggcagctcatcgacgcgatgggtgtagaacacggcaaagagctggccgacatcaagctctatctcgctcgcgggggccgcatccccgaagagccctacgttccgcaatcacagaggaaagaaaatggacaccaacaacagcagcccggccaacccggaaagtaagatgccgttccgtcgtcgcgcgtgggagttctggcgccgcaaccagatcatcctcttccagctcccggtcatgctggtcttcctcatcggcagctacatcgtgctgaagtcggtcgactctcgcatcggcgtcgaaggcttcggcgacatcttcggctacgcgctcaacgcggtgcgcatcacgctcatcatcttcaccacatggtggatgaagaagtggtgctggttcgacctgcacgaccgcaccgaactcgaactgttcgacctgcgcaagcaaggcaaccgcgacgcgcactggatcgtctggaccgaccgcatcgagtggatgctggcgctggcgttcgcgaccttctggtacacccgatgagcgcccgggtcgtagtcctcgctgcggccctcctgctgggcgcgtgcgcccggccggcagcggtacccccggtcgaccagaccgtgctcccgccggccgtggagagcctgccagcggccacgccggagccggtcgccgagcaggtcgtctcggcccaacccctgccccgggccgagcaggcggtttcggagaccgtcacggagccgcttctggctgcgcaggcggcgctcgcggaccttaccccgctactacccccgccgccggcccgggacgcggcttgccggcgcgctgcggcggccctgacgctacgctgggaagtgaccagcccggcgttctaccggaagcggctcgaactgccgatctggccgggcggggcgtccggggtgacgtgggggatcgggtacgacggcggccaccagccccgggcggtgatcgtcgacgactggcacgaccacgggcaggtcgaccggctgggccagaccgccggcatcgtaggccagccggccaaggtggcgctgccgcgcttccgcgacatcccgactggcttcgaccacgccagccgtgtgttcgaggaacgcagcctcgtcgagtacgagcgccgcaccgagcgcgcgttccgcaacggcttcacggagctgcggccgaacgcatgcggggcgctaatctcgctggtgtacaaccgtggcgcggcgatgaccggcgactcgcgacgggagatgcgcaacatccgcgacaactgcgtgccgaagcaggactatgcctgcatcgcttcggagattcgcagcatgaagcggttgtggcgcggcacggtcaatgagaacggattgtctgcgcgccgcgaggccgaagcgatcctcgtcgaaaccccgtaaggagatgagcatgtggacgaaagcaatcgcgtggctgttcggaacggcgatgggtcgcggtgtgctgcttggcggcagcatcgcgataggcatggcgctcggctggtatgcgttctcgacgcactactacaacgagggcgtcgcgtcttgccaagctggccgcgccaccgatacgaacgcggccaacgtcgcgcaaggtgaaaagaacatcgccgacaaccagaccgcttcggaaatcggcaaggccgccgacgccgaagcagcgaaggtcgcagccgatgccgaagaagcgaagaacgactcgaaggagaccatccatgatgtgtacaaaaagccgcccgtcactgcgcctgttgctgttggttcttgtgttcaccctctcgacgagcgggtgcaagaccggatcggcaaagcgcgagctgccgcagttgaagcaagaagcgcccctcgttaactgcaagcagcctgcgtcgccggcagtgccgcgcgagccgaaggccgacgagtggatcgagtggaacccaccgcgcccgggcaagaccgaaggcgaagcgcggctcagcgagcgtgcggtgaactggatcatcgacgttctgggcgtggtgcgagtgagcgaggggtaccgccgcgtcgagcatggatgcctcgacgacctcgaagcgaaagggctcatccggcagtagttgacaggcccgaggcgctgcattacggttgatcccgctggtggcacttcgcgttgcatcggcactcggcagagggacagcggcgcggtgaatcggcgctccgcaccgcagggaacgaggaaccccggactaaccatccggggtttctttttgcgtcaagaccaagtgcgtcatgaccaagttcgtcaagacccaaaaagaaaccccgccacgttgccggggcggggtctcgggtcgctgcggcgtcgcgccggagcagtgggtatcgaggcggcggttctgctgattccggtgtccgctcgtggagcgctgcgccggctggaagggcaatgtcgcgtcgatgagtcgaccctaatgcgatgcgctcagggtgtcaacaccttcgtcagtccttccacgtctcgaccagcttcatcatcttcttgcgcgccttctcgacgccggcactccacttgtcccacgccttcgtgtcgacgtgcgtgaggatttcattgcgcgccatttcgctcagcacggtcggcggcagcgcgtccagctcccagctcttgtcgccgaagcgctggcggtatttcacgaagcgcgcgtcggtcgtcttggccgggttcggcggcggcttcagctcttcgatctggtcgaggttcaacgccatgcgcttcagcgtgaactcgccgttccagccgaacagctcgaagcgctcttcgaggtcgcgcgtcatgtcgatgccgctcgggtcatggtctccgaagtgcaggatcacgacatccttgccgtcgctctcttcgatttcccgcttcgcgaaatcgcgcacgaccgatgcgctcgggtagccgcgcgccgcgagcagcggcacgtcgaactcgtggcacacgcggctgaagacgccgaccagcgcttccttctcgacgacgaggaacaggcgcttctcctgcgtcgcccacgggtcggtgtggtactgccgtgccgacgccgtgagaatgtcctgcgggcgcgaccaacggctgcgctgctcgaacgagcgcgtgcggtcttcgatggcgtcccaatcaatcaggccggcgatgcgcgcgtcgttgacgatgctcgtggtctgcttgtacgacttctcgttgttcggaatgatgtcgcgcgcgacgagctggtagtagagctggcgcacggtcagcgtgtaccccgcatcaagatattcttcgatgatcgcgttgatcctgtcgatctgttgcagggtcttcgtcttgaaggtgatttctttgtagcgttcgagactcatggcactcggctcctgttagcggttggcgggctgttcggcggcccggatgtcagtggcgcggatggattcgatttcaggcgacagctcgatgcgttcgaccgcatagcccacgtcgcgaccgtagtacacgccgcgcacgtcgggcaccgggtagatgtggtagctgccggcgtgcgcgtgcagcgcgtggtggatgcgctgctcgatctgcgggtaggtgtacgggttgtccgggctcggttgcacagtgcgcacgccgatgccgacgtagccgctgcgcgccagcgtctcgcggaacagcgcggtgtggcccgcatgccacggctggtagcggccgatcatcgtgccctgcggcgtcaggtagcgcaggcacgcggcaatgcgttcgagcgtgggctgcatcacttcggccgtgacttgcaccgcgacctgctgcgggcgctcgaacatttcgtcggtgtccgggtagcggctcttctgcaccgtgtccatgaaaacgatgaggtcaggtgcgaacgcctcgcgcgtctcttcggtcgggcacacaaacgacgcgacgacgaggccgccgttggtgtcagccagctcgcgcatgcgctgcgcctgacgcacgcgcccttcgtcgctgaagtcccaatcgctgtacgtgctgcgagcgttgtcgccgtcgatgtgcgttgccggcaacacgcgcgcgagcgctgcgccgagggtggtcttgccgctgcccggcagaccgcagatgagaattcgcttagccacggcgggcctcctgagcgaagttggtcaggtactcgacggccttcgcgtaagtccacgcatgcacgtattcctcgcccttggtcacgtcgtcttcggtgatgacggcccgcacttccgtcgcggtccaatcaatcgagatgacgcgcttacgccagccgatcttgaccgggccaaactcggtcatggcgagccaccacgggctgtttcgacgaatgtcgtcgtagtgaggcacgttcggccagtagccgttcggaagttcttccgcgtgcttgaccatgatgcctgccagcacgaatagcgcgagcatgtgttgcttatccattgttcgattccttctgtgcgcgaagttcttcgcggatttccatgagcaacaggccgagatgattctcgcccttgccttcgcatacgccccaaaaacggtcgccccaccaattcccttcgacgagcttcgacttcccggtcttcagcaggcgcgaccgcagcgggtcggtgccgaacttctggcgcagcaggtcgcgcatgacgccgaccttgatctgctcccaatcttcgcgcagcgttgcgtgcttgccgcgctgcttcgcgccagcggcgctcggctcgttgcgaatgcgacggcgctcgtcctcgtcgagcgtcttggctgcttggaaggcgtgctccacggtgcggtacgagtgcccctcgaaggcgatgcagcatgaccagaaattcgagaggaagcggtacgggccgttgaagctgtcgatggtcttcatggtgtcccctagtggaagtcgatcttcgccttgctgaagagctggcgctgcttctgcatgtcggtgcgagtgatctggtcttggatgggaacctgcacgttgcgattcatcatctggtgcaggtagcgcggctctactgcgtgcccggtcgcgaacttcgcaatcgccatgagaatctgaggcgagtgcagctcgaagaacgtgccggtcatcgaccacgggtgcggccggatgtgcgccgcgatgtcgagcagttgccgctcggccttgcgcacgttgagcggcggctggatgccctgcttgcgcatggagtgctcgacttcgctcgccgcacgatgcacgacgaggtactgcgcgcccgggaaccggacgagcagttggtcgaagaagaacagtccggccacgtccgacacgaacacgcgaccggacggctgcttgtcgatcttctggcccagctcagcgatgcttgcgcactgctgaagcgggttgtgcatcgacgacacgcacaacggccgaaggaactcggccatccatgcgctgcggctgcgcggcaggctcagcatgatcgtcaggtgctcgtatgccacgtcagcctcctacgcggttgtgctcgtcgctgagcttgtcgagctgccgggcctcggcgtagctgtcgagcacgcggacgaacgcatcgtgcagcagcgtgccggcgggcacgtagatcactgtgccgccggtcaggtcgttgcgggtgtagatggtcggagccgcgcccgggatgagctggccttgaccttctggcgtcgcctgcatgcgatccggtgggcgcgagtcgaactcgcgcaccatgccgtcagccggcccaccgacgaagaagcctcgaacggttgcattcatcgcacgtctccgtcgccctgcaacgtgccgcgttccttgcgtccgttgagcttttcgcggttgtcgaacagcagcttctcgtagccgccctcgcagcccaccagcggccccgtgcgctcggcgtactcgaccgacacggcgatcaccgcagcgagcgcaccgcgcaactcggcgatcttctccgcacgcttctcggcgctccacgtcgcaccatcgcgcatcatcttcttgatgacgcccagcacgcggccggcgtgcgcacacagggccgattgcaggtcgtagccgctgatacggacctcgcggtactcggcgtcggcgaggcgctgcatgccttcctgcaccagcacgtcgaagcgcggcagctccggggtctcggcgcacaggcgcgcggcgtaccactgcacgtcgcccagctcgtgccacgccttccggtagcgctcgacgcggaactcttcgcggatggcttcttggtcgaacagctcggccagctcgccgacttcgttcgacagaccgatgccggtgtacagcatgccggcgctgacgttgccggcgagctgcacgatgtcggtcgggtacttggcggtcgtgacggtgaaggcgttgtacgcctcggcgaagacgcgcgtgggctcgacgcgcgcagcacgcgactcgcgtgcggtatcgagggacaggatgctcatgcgcggcccccggcggccagcgcctcggcgaagtcgttgctgtagctggcgtcgaacttcgtcgccatgtcgtgcagcacgagcgtggggccgccgtgcgcggccgggatcatcgcgaagtcgacaccgcgcacgagctggttgcgcgcaccgtcgtcggcgatggcgtggacgaccagcgcctcggggttctcgcgcgcggcgcgacgctcggccttcaggatgcggcgcatggtcttgccgccgaacgccttgcgcaacttctcctgcggcgagccgtggtcgcggatcgcgaggacgccggcaatgccgcccttcgacgtgcgcacttggcgcttgttcttctgctgctcgttcgcgttgtcgcgggcttgcagcaggaaggcgtagttctcgtcgacggcgagcatgcgcttgcgccacgggctcagggtcttcgccttctcggaatcgtacgaacggaaaatgcgcttcaacaggttcatcgtgtgctccttggaaatgaaaaagcggcccggccgatgtcgacagggccgcttcgatgtactacgtcaacgccacgggctcagcggccggcgacgaacttggtctgcttctgcacccggccgcgcttggtctcgcggaacagcacgatggtcgtgttgtcgtcggccatgatgctcgcgtcgtcgagcgcattgccctcggtcgcgaacgggccgttcatggtgctggccttctgcgaaccgtcttcctgcgcggtcagcagcaggtacgcgaactgcttcgcgcccttcttgccacgacgcacgccgaccttgcgggcggcagtcttcttgccggccgggcgaccgcgcttggcgggcgcagcggcttcggccttcttcgcgacgcgcttggccggagccttcttcgcggcggccttgcgtgcagtcttcttggcggccttcttggcggggcgcttcttcgcgaccttcgcctcggtggcttcggcgttctcggacatctggtttctcctagcgttgttgtcgacaactcgcggaatgcgagcggggttcccttgcgggattcggttcagtccacgcagtacgcggggacttcggtgcggaacgtccgacactcggacggctgcgtgatgtacaggcccgccatgcaggccagcagcagcacgacgtagacgatcttctcgcggcggctcatcactcgcagcccacggtggcgttcgcgcgggtcgggtgcgcggcggtgtactggctgaagtcacgccagccttccgagccgccgcacgcgaagccccagcggcgcacgatggagccggtcatgaagagcgtccagcacggctcgtcgttgttgccgaacagttcgagcaggtgcatgtggtcggcactcaggcggcggaagtcgcccgtgcggaactgctgcgtgtagtcgaacttgtgctggcccgggaacttgcccttgttgcgaacgacgctgccttcgacgtacgtgcggccgtcgcccggggtgaacagtcggtgcatgtacgagacgtgtgcgtccatgccggcggcgctctcgtcgatggcgtgctcgtagcaccactcgctcgtgtgctcgatgtagcggccgtcgaggatgagcgaggcgctgacccacggatggtcgtgcagtgcgcggtcgtcgtcaccgtggacgaacttgtgcaggtacaggttgaaccagcggttgcgcgggattatgtgccagcgcgtcaggtacgggcgacgcgggccgccgtcgatgccgtcgagcatgatgaccttggacggcgagacgagacgcgcatacagcttgaacgcgccgacgaagaccgaccataggccgatcatcgagagcacgtcgtagaagcgacgggagaccttgggagcgatcatggcggggaacatcctcgggatgatggggtagttcatgcgtcgaccgccgcgtcggcggtggccgggccgtccgcgttggtcacgtcgacctgcggacgaacgagcggcaacggctgcgagccgtcgaggttcttgaactcgatgtagtagcgcgtgttgagcgtcttcagtccggtgtcgacacggttctggaagacggtcagcaactcggccttcgtcagctccccggcgtgcatgccgccttcggagacgacgcggaagttctcggtgtcgccgctcgtgagcatggcgaggttgtggcggtcgaggatgagcttgtcgagcaagtcgcggatattcggcagttcggcgaagtcgattttcattggttctctcggcgtgagatgaagagcggcgtatcgtgccgcaagccgccgggttgacccttcaagcgctggggagtgcgccatccagttgaccgggggtatcgcctcggcgaccccgtgcagttcgtgatttaccccgtagggggacgaagtaaattcgttactgcggggccactctagcgccagcttttcggcttgtcaacacccttcctcgtgtccggcggccggctcagccgggccatcttgcgctcgccccggaagagcctgtcgcgcagcatcttctcgctgacgtgcgggcagtgtcgcttgatctgctcgaacgtcatttcgtcgccgtcgatggcgtacagccgaacgcgcgcaacctctttcactgcgtaatcctcgtcgtcgaatttctgcctgctcatagcgcccgcccgtgggtctggatgtaaacgtcgtgcagcatctcgtgagcgactgccttgcgaaacgcttcctgctgcacaagcgcatgcgcgaagtcgcgagcgctcggctccttcatgccgagatgcgcggtcatgcgcagcgcctcgtcgatgatggcctgcggttcgccctcggcgtagccctcatcggcgagcagcgcatggatagcctcgcggtacttcgcgtgccgcgcgcgctgccgcagcatcgcaatgccagcgatgacgttggggccgatcaccagcagcaaccaatcgaaccagctcatacagacctcgcgtgtggacgctcttcgccttccttcggcgcaggaacgtggtggagtgtttcgagtcccttcttgatctttgccgccatcgctttgccgaactccgatgcatcgccgtacatgaggtcgaggtcagggtcagcgcattcggcggcgacgttgcgcagcgtgtcgagcagcatcgggagctggtgctgcgcgctgtagttctggtggatcatcggccacgcgccctgcgccttccaccactgcttgcgctcgtgctcggtcagcgcgacgtattggtcgatcatcgccatcgcgaggaacggcgaccaaaagcacgtatcgaccggcgtgatcggctcgcccagctcatcgagcgcgaagtacaccgcgaatacgggcgtcgtgccgatgagatacacgggctcgtcgagcgggtctttgtacgtggcgatggtgtagccccggtacgcggccatgtgtgcgtagcggcgcttgctggcgtcagggagtggcatgcgaaaactctcgttgaagtacgggtcaagggacgctgaggcgtacaagcacgcctgcttgggctcaggttgcgcggctctcatggcgatgaagctgcgctcgctcacgcgccgcccgcgtcacgcacgagcacgacaggctcgccatcggcgtctccgtcaggcaggcacgaagcgagcacgtcggccgcgccctgcgtgtcgccgagcacgagcagttggatcgcggcgcggatcgcggtctcggtctcgaccgctttgcgctcggcggcgagcacgtagcccgcaccgtcgcacagctcttcgagcagatggcgcaaccactgcgcggtcgtaaggtctttgcgatccagcgtcacgccgtacttcttcaggccggcgtccgcgcgctgacggatgatcgcgatgaggtcgttcgtggtctgcatgtcgctcatggtcaaaagtccttggcaaaatcacgttcaacgcgcagcaaggccgaaacctttgcgtcgaactttttcggggtgtcgatgaggatgtccgccgcagcgcacgcgatgacgggagacgtgaagtaggcttggatcgggtgcagcacttcgccgaagtcgtcgacgatgtagtaggcaacgtggacgccaatgccgccgtcgagcacgaccagcgggccgccgtcgctgcgcacttggtcgctgtgcagctcggcgatgaacacgtcgcggtagggttggatgcgcttgaacttcatgcggctttttccttcaggtggtcgagctgccagccggcctcgattgcagcgaacaaccgcagctcgctcgcgtcgtcgacatcgaggcgcaggtactcgatgaagctgtcgatcatctgcggcgtcatcgggcgcttgtcgtagaaacggcggtatgcactttgcggaatcatgtcccacaccgggcacaggtcgacgatacgcttgccttcttcgcgaaggtggcggcgcatgatgtcgcgcaccgtcttcgggttcttcttgaccgtgatctttcggccagtcgacggacggaaactcatagcccgatgtcctgtccttcctcgcgcttcagcagccacatgggcttgcgcgagagcatcggcagcgggccgatccagccatcgacggagccgtggtgccggttccatccgtagttgtcccaccagcgcccgcgcatctggccgtactccggcaaccacacggcaatttccatctccgcgtgctgcggcagcgcgtgcgggtacgggtggtgccagatggcgtagaagccgaactccggcgggtcttcgagcacttcgatgtcctcgtagcgcatcggcccggcccagccgagcaccatgccggtgaagggcacgaacggcgtcttcaggcttggcctgcgctcccaccaatggccgttcgcccagcgcatcaccgcgtacatgcgcgggtcgtggacgattgtcgggttgcgcgtcaactcgacggcgtacagcccttcgactgtcggatcgtcgagcacttcgagatgttcaatcttcgtcatgcggtgcctcaacgtgcgcgcgtagtggccgcaggcgcggcagcgggccgatccagccgtggacttctcccctgaagtattggtcgctgttgaggtagcaccagcgatccccgaaccacatgaggaagacatcgacgacgagcccgcgaccgtgcgggtcgtctacgcggcaagcgtagacgcccgtgtcctgcggcagtccgatttcttcgtactgcaccttcatgctcactcgcccttcggcagcggcagcgcgtagaacagcacttcgccgttcatgcgctgcacggcgacgaccgcgtggccgagcttgcgcgcggtcttgatcgaggtcgtcgtgtcggtgctgacgccggtctcggtgccgatatgcacgccgcccgggtactcgtgagtccagctcgcgcgctgtgcatcgagcacgctttccagctcttcgacgcgccgcttgtagcgacgcgcgtcggcctgcgagatggtcttggacatggctcagacctcttcgcgagcggagtgggcctcgcacttggtcacgagcagcatgaagtgctcgtgcggcaggcccagcagcgtgtcggcatcgagcgtggcgagcgcttccttcagcgcggccttgccgtggtgccgggcgaacagcagggcgtagtggcgcatcatctcgcgcatggtgtcctgctctcggcgcacacgcgctgcgtcccacgcaccgccgcgctcctgcttcagcttgtcgacctcgcgcgtgcgcacgcccagcaaggacgacagctcgcggttcttgtccgacagcttggcgacctcgttggtgctggtctcggcgatctgctggtagttgcgcatgtgcttgttgatcgagcggatagcacgcagcgcgaggcccacgtcgtcgatgttctcgtagtgcgcgcccatgttgcgccagccgggcaccttgcgatccagctcgcggtaaatgacgttgagctgccgctcggcgtcggcttcgcggaagtccatcatcgcctcagccgcagcgtgcgcctgctcgccgacgttgcgcagcgcctcgctggcgtccttcgtgtccagccgcagttcgacctcgacgacctcgcgcgcttcgccttcatcgtcagccggccgccacgtcgcgagccacgtcgcatggtcgcggtaggtaaacttggtgcggtggccgtcgccgtcgcgctccatcgtcacgtagtagtccgtgctgtccggcttgcggcgcgcgtcgatcacggtgtaggtgccgcccgagatgacggagaagtagcgctcgccagcggccggcggctgctcggtgccgtcgaactccacgttctcgatgaagtcgcggaacagcgactcgatgaggccgtagcccatgccgagttcgggcggcatgccgacgcggcgcgagcgtgcaggcttgaacgacacgtcatgcagctcggcggccatctgcgcgtacgggttgcccgggacagcgccggcagtcgtcggtgcgaacaggtcgttccatgcgctcgccgtggtgaacgtccattcgtactcgccgccgcgaccgttgtcgacgcgcagcatgcggacgtggctgtggccctcgcactcgtgcgtgctgacgaccatgaagaagcgtgccgggcggttgcggtcctgccagtaggtgccgaccttcggcgcgaactcgtagcccgggtggccgaccgtcaccgcacgcgcttccttgcggtcgctcgctgcgcccttggtcgtctgcgtcttgctgaagtcgcggcgcatgatgcgctcgatgaggctcggcgtgcccttcatcgcatcagcgatagcgtccgggctgaagtcgatggtgttgatgatgtggatttccggctgcttcgagaacgggtactcgcggcggtgcggcttctcggccgagaacacggtgccgtcgtgcgcgttgaagaagaagctgtgctgaccgatgaaggtctcgcgaatccacttgtgcatgcgctgcgcttccgcgcgctggtcatcgctggtgccgacgacgccgccggtcgcatggatttcgcgcacgatgccctgctcgtcaacgcacgcagcgacggacacgatcatgggggtggtagcggtattgcggaactgcttttcgatgtgatgagacatttcggcgtttcctcggttgagttaggtggtgctgacgtgaccggcggcctcgcggtcgagttgaaggtctgcaatgtcacgcaacgacgagggccaatcgtcgagcggcacgagtccgtcctcgtgcatggtgatctggtcaggcgtcataccgcacaggtagtacgccttcgcgagcgagaagcctgcattgaggcggtagcgcttcgctgctgcgccccacttcaccgactcgcgctcgcgccagtcgatccagccgcgtgcgttgcacagtcggcacggccgcatttcgtactcgtcatggatgatgtgcgtgagctggtgcttgtggccttcgcacttcgggcagacggtgcggtcgaacagttggagccatgcagcgcgcaccttcatccgcagggcgagaattactgcgcgggtcagcagggtggtagcgctgcgcaggcgagacaaagggggtaccggagcgttccgaagagccgcaagcctacggcccaacattttcgcctctgcgatttcgcggtgcgtgtggcgcatggctgcggtcactccatccgggtgacggtgaggaacgcaaacatggcgtcgttgctggcgctcatgtaggtgccgcgttccatcttgaaccgcttcgacttgtgctcggccacgccgcgcaccttggcgatgccgccgctcaggatcgagttctgctgcttgaagtatttctgtgcctcgttgttgatcgcggcaatgttgccgttgtcgagcgggatgcgctggcagcgcgcgtgcgactcgccgatgtcgagcttgctgagctggtcgttgagcgagcccggcaggaagatgagccggggcttctcgacgatgcgcacgcgcgggttggcgatgtgcttcttcagtgcggccttcgaccccggcttcttgcgggtcttctgcgcagtgttggcgctgctgttcgtgctggcggatgccattgggtgatgcctcctgttccggggaagtaagcggacaagaaacatactactgcgcgcacccggggtcgtgtcaacccgggcgttctcggtcgtgaccagctcgcgcgccgggccgatgccgcatgaaggtccggctgggttgccgaagcgggcgcaatttcggaaccggctaggtcggcgaagcgagagcgcaaacggaaccggctggctttgcgaagcgggccgaattttggaacgggctgggtatccgaagcggggacgtttttggaattgctctcttgcatgtacgtgcgtgcgggcatgcgcatgtgcgcacgacgcgcgctcgctcgcacgcatcacgcgcggttctcgacgcgcgcggcgcgcggttgtcgtgcgcccgcatgccggcgacgcgggcgcgtcaatgctgcgcgcgctgcgcgttgcgcggttcccttcatccgggcgcgcttgccgccttccgcgcttcctgaatgcaaagtaaacggactactgcgcgcagtaaaaaaatacttgcgcggcgcgcggaaccgtgtagcctacgcataccggcaacgtcgccggcatcgcaaagggtcgcaaacatggcacgcatcgaacgctccgaattttccgcccatgccgcgctggccgcgtcgcgtggcgcgcaggctgcgcgcaaggtcgaaaccgcgcgcaaggtccagacgttgcgcgaccttatcgcgcgccttccgtttcttttctccgtcgccgttgccgcctttgtcgcggtcgcggccgtcgccgtgtccgtcgtctaagggagcccgaatcatgcgccgttatcttttcgtttcgtccgctacgcttcccgtcgtcgcctacgcggaaagcaaagacgcgatgcgcgcatacgtgcgcgacctgctagggattccgcacggtttcccgctgccgcgtcatgcggttgtgtccatcgcctaacaattcaccagacaagggagattcaccatgcaacgcattagcctttcgcaagccttcgcacagtggcaagaattggccgcagacattccgcaagacgacgcgcccatgctggcggaatcgtggaacgattacacggattccctttgcaaagatggcgcattgtgcgacctgcaataccactacgcgcccgcatacgatgaagagatgcccggcgacggttcgcgcttcgatccgctgagcgatgaccgcgaattcatcctagacgcgctaggcgtcaccatgcgcgcaacgcgcaaggatggaccgcgcgaaggatgggacgcgagcgcgtcacactggcgcgtcacgctgcgccgcgaccgcgcgagcatgacaacggattacagcatgggcgcggcgcatacgggctcgcctgagctggcggacgtgctgaattgtctaatgcgcgatgcggaatgcggcgcgcagtctttcgaggatttttgcgcggaccttgggtatgacacggattcgcgcagcgcggaaaagacgtggcgcgcgtgcaaggtaacggccgtcgggctcgcgcggcttttcagcgatggcatgctgcgcgacctgcgcgaattgttcgaggatttttgatatgtgcgagcttgacgtaaccgcaatcgtcgccagtatcgcgccgcgcgattactcggcatccgttgctgagctgggaaacgatgccggccgcattacgtgggaagccgcatgcgaggatgcgcgcgagcttttcggcgagcatttcgaccgcgccgcattcgatgagtatttttcgcatttcggcgcgtgggacgctgaagaattggccgcgcatacggatgaagaatgcgccgcgcttatgctgcaattcatcgccggcgacatgcgcgaggccgatttttccagctatgccgacatcgaaggcggcgcggaaccgttcacggatgaatggtggccgcagtatgaaaccgcaagcgaagccggaaccgtcgccggccgttttttccgcgcagacgatggccgcgttttttactacattggagaatgaacatgcaaagcaaatgggcaaagacaaccgcgcagcgcatcgcatccggcgagctggcggaatccatcatccgcaaggcgcgcgcgttgctgcgcgatgccgtgaacgctgaagagtatttcaagcgcgaaccgtcgccgtctgctaccgctgcggaagcgtgggagctggtgaacatgattagcacgcatgcgccgcgcgtcacggatgcgcaagcgcgcaagggcgcggaatggctgcgccgccttgtctacacgtcgcgcggcacggtgcgccgcacggaagccgcgcagcaattcagcgatgcggacctgcgcgttttgcaggcttgcatcgcgcgcccggccttccgtctggtggagctggaaccgcacagcgacggccgatacctgcgcgaccttgcgcccgtctatcgctgcatcggcgacaacggcgagtccttcgattacacggcgagcgcgtggcagtctggcggcgcgttcgcaatcctgcgccacgcttaacccttcccatccgtgataagcccggagaatctgaaaatgtacagcatcgcaaacaacgcaaagcccgccattctgacgcgcacggaatcgcgcatccaatcgcagcgcgacaagcgaacgcgcgacacggaagcgcgccgcgcaaagtatcggcgcaacgctgcgcgctatctggccgcgtctttctggcaagggtcgcgcgacatcgccgattttttcaagggtcgcggattcgatcatgcgacgttgcaggacgcggaaaacgattgcatggataacgtcgatttttcttatctgtattcccgcgactatgcgcgcgagctggaaaaggaatacggcgacgacgcgcgcgaattgttcgcgtacctttgcccggatgcgccgctgagcgtgtaccgtgagcaaatcgccgacgacatgacgcgcgcggttgcagactcgcgccgcgcggattatgcgttgcagtttttcgactggtgccgcgatgcggtcgaggatgcggccgattcttccgggcttgtctggtgctggctggacaaggccggcaagcctacggatcaggaatacgacgcgcacgcggtaggcttcgcatgctcgcgccgcgcgttccttgatcgcagcgcggaatggtggccggaaaaatggtgggcgaaaggtgaaacgacgtggagcgattacgcgagcaaccgcgaacgcatggacgcggccgacgacgtgctaagcgaatttctcggcgagcatctggaaagcgaaggcgcggaccttgaatcgttcgatgagcgcggttcgcgctatgcggatgatgattattggccggaatacttcagcgactacagcgaagcgcgcgagcaatgggaaaacgacaaagcaaagatgcgcgcgcgtctgcgcgagatgatcgcgaaccgtgcgccgctggaattgcgcgccgcgcttgtcgcgagcgtgtacggcgagcccggccgcgcggccgatgaatccgaagattgaaagggagctaacgacatgacgacgattaccgcatacgcatacaatgccgcgcttcattgcccgcgctgcgccttccgttatttccgcgtcgatcctgcgaaggtgccgccgggcgcggatgcgctggacggttgcaaggatcgcgaagggaacgcgcccgcgccgctgttttcgacagacgcgaacgcggatggatactgcgacacttgcgacatggcatacggcgacgcggaaccgcgcgcgcacgtcctgagcattgacgcatggcgcgagcccgaaggctggacgtggaataactggcacaagcgcggcacggtgccggttgcatggtgcgacctgagcccgcgcgcgttgctgcggaacctgcgcgcgttcgggctcgacctgccgccgggcgcggtatgcgtcgaggatgacggatacaacgtcgagattcaggcgcgcggcacgcgggaaccgttgtatgccattgcctacggcgaggcttgcgcatgacggaaccgacactaaacgaaaaggcgcaaattctgcgcgctggcattctggcgtatcgcatagaacgcggcgcgcgctggctttgtttcgctgccatcgtatgcgcgggcgcgttgccgctggcatggggagcgttccgggcgcatggcatcgttagcgggctcgccgtgctggcgctggtgctggcgctatgctggcacgtcaagccgcacgggcgcagcctagcggcgcaagcgcgcgagattgaagcccggttcaagccgcacgattaaaagcgcgctgcggcgcgttccctgcatcgcctaccctgagcccggccgcgtgccgggctttttattgcctgcgcgtctaggcgcggcttagcagccttgccggccgcacgtctgcccggccttccgtatcccttcgcctgagcccgtgcccgcatcgcttgcggccgggcttttattttgcccgctgcccggccttgcccgggctcgcatgcgtgccggcctgcccgctgcccggccttgcatggtggcgggcttattcgctgcccggccttgcatgcgggcggcatagctgcccggatgcggcaacgtggaattaatgcagcgctgcgccgcataggtgcgcgcgtgcggcctttccgaatttatttattgcatcgcatgcccgcatgcgtgcgcgccgcgctgcgcgcgttgcagcgcgcgggaaagggataaagggatagcgggctcgcgagtaaaaaggtacttccggcctgcgcgaaggcgtcgcggggggcgctgacctcggtgctcgcgcatttttcggaatttttgcgtttccgtctccaatcgacccccgggccgcccggaaattgccgaatatccgccccgcgcgcatttaattcgcttgtgacagtacctttcagtgtcacaaagtagtgtcacatggttcggccccccgttgaaaaggctgaaaacaaggcgtttttgcgcgcgaatttactgcgtcagaccccctcagtgacactgtgacagtgacttcttttcctttaccggagaaaagtttttctgccttccaagaaaaatttctcgcgtatgagagaaggtactgtcactactgtcactactgtcacaaaatagggaaaagagtaggtagatcaatgacttgaatttgtgacagtaccttgtgacagtgaccgattcgcgcctcggagagcatggaaaatcgggtactgtcacaagaattgccttttttccgaatttccgtccatacggtaggaattttttccgtatgtgacagtacctagaaatccgaatttttcgcatccgtttcggtcgggcactatgtcaagctgggatgagtcgaatttccgccacgcgggcaataaaaagccccgggggatgagcccggggccggtgttgcggaaattccgaggaattaaatcgagttgcgtgggttgcgatcctcgacgcgctcgtcttccacgttcgagccgttgtcgccggcaccgggcggaaggtcgccgctctcgtagcggttcgcgtcggtgttgttctcgtcgacggtcgcattcggcaccatgccctgcggcttcgacgcgccgaagaattcgccggtctcgcgcgctgtgacctgcaagtcaccgtgcatcgtgatttcgaccgagcggccgggcgcatcgagcactgcatgcaccacgccctttccgtcgaccaactcgaccgccttgttgccgttgacgtgcgtgaacttcacggtagtcgtcatgtcgtttctcctgtgctcgggattgagcgtgttcgatcatacgctcgcagacgtgaaaaagcccggttgcccgggcttgttcgttcacaccttcagcgatgttacttcgatgtagtcgtcgatccactgctgaaggttcggccgcacgacgacatccggcgagcgtgaccaataccgcgcctgctttccattcgcaccgcgcgcgcggcccacgtacacgaagcccttcgaggtcaggaagttcgacaacttcggcccgtacggcacgccgacactgttgtccatcgcgaggtcacgcagcttcccgacgttgagcagcaggctcgtcacttccgggtcgcgcgactccgcgatcatctcttcgatttcgtcttcgtcgtcgccgcgcgcgaggtcgatcatgcgcgccttcgcgtcggtcatgggcgcatggccgtccgggtcgaactcaggatgcagcgggtagtcttccagccactcgcggatcgcgcccgggtggtaggcgattgcgttgaagatgtcgtcgtagtgatccgggttgcgcgcgcggaacttctcgatcatctgcttcgtctggaagtgggtcgagatgacgaagtagcggcggtcggcgtcgtacaccggcagcgcatcgctgtggttggtcaagatgatcgtcgaggtcacgttcggcacgttgtacgagtcgcggtgcatgcggcgaatcgaaaccacgtcgttcgtgatgaagggcttcagcttgtccatcaccgcgtagcgcgacgtaccgtggatgcgtgcctcttcgagcaccacgaccttgcgcgactcgaagaacgacgtgtacttctcttcgagcgcctgagcgttgacggtctcgacgttgttgcgcgacatgatcgccatgagcatttcaccgacgaagcccttgcctgcgccgtccacgccctgcatcacaaccgcccaacggattttcttgtccatgcgcttgatcgtgtaagccagccacgagagcaggatttcgcgctcgcgctcgatggggtacgaaatctcgaagtgacgcttcacggcttcgactgcgcgccgggccttgctgctcagcttgtcgggcaccggcacgatgtcttccgggttgaacttgttcgcgtgcttctggccgtcccactcgacgatgcggtctgcgccgggcaggtagacgtagccgctgacgaccggaacttggtacacgttgagcgcgagtgcggcggcctgttgctcaggcacggcttccatgttcgagcggtctttcttcgacagcaggaaacggttgttgcgcgcattgaacgcacgctcgctcagcgcgaggcggttgtccatgtagtagaactcttcctcggcgtcgacgtacaccacgtcgttgcaccaatgcggcagttccttgtagttgaagtcggagttgcggtagccctcgttgatcgccttgcggatcatcgcgatgggaaccttcttccccagctccgcgacgcgctccttaatcgcgccggccaacagctcgacttggaagtcgctttcgagcatgcggccccacttcgcagcaagcgggccaagcaactccatctcgctcgtcgtctcggcgaccttgcgcttgatcttctcgaactgttcctgcgagtgctcctgccgatgctccttcgccatcttgataagcgaggcggccgtcgtcaggttgcggcccatgtcgtcgtggaacgagttccacttgaactccaattcgtcggggtcgtagttgtgcgctggctccgaccactcgtgccacaacgtcaagccttcttcgttgccgtcgaattggtgatgcagcgccatgccgaccttcaaccactgctcgtagtcgtcggcaccgggaacccactgcagcacttcgcggagctggtcttcggtcaggttttccagcgggcgcttgtattccagcagtgcgttgtcgttctcgtcgtcgctgctgcgcgactcgctcggtgcgttgtgcttcttcaacgtccatccgcgacgctgcgcttcgagcttgaacaccgagaagagttcgtcgatgtgctcggtcgtgatttccggcagcatgtcggccggcacgctcagcgggttgagttccttgcccgaagtccacttgtacggcttcttggtgtcggggtggatgccgatgccgacgaactgctggccgtctgcgagcacttcgatggactgctcgtggccctcggtgtcgaggaacgtgatcttccgcttcgagaacggaatgtcagtgcgatacacgagcaacgtcttcggcgcacggccgacgcgcgtcatcgtcttgccgatgatttcctcggtgtgctcggccatgagcgccgccatgtcgtcatcggtgatgtcgatgtcgaccgcaggcgtgtgcttcgtgtggaagccgatgttgccctgcttgtagttgccgctcgcccacttgcgcacgagcttttcggtggcttggattttctgccactgcggttcaatcgggcctttccttcctgccgggattggcaagatggagtacccgttttccagcaattgagcgccgtacttacggagcacgctggtgatcggtcgtccagcagccataggtcactccgcgatgtcgtcgctaacaaggtcttcgaggttgaagccgatcttgcggttgaaatccttgtgcaagatcgtggccttgtcgcgcggcacaccgccgaggcgctgccaacgcgagacagtggtctcgtgccagttgtacttctcgcagattgcgttgagtcgaccgtacggcgggtcgagcatgagggcgatgcgccggagcagatagcgcactcgcgcatctgcgctatccagtgaatcaagggtagggtctcggcgcatgaattcctcgcagacattgggatttaaggggtctgctaagtcgatgagcatgcctattgacttagcatcgggacgggcgcatagtgcgctcgccgggcaggaattgcaatccacccgtcactcccaaaaccaacctagctaggagatacaaccgatgtcgaagctcaacgcgaagtcgctcgccgaagccattgccgccgctctcgcacccgtgctcgtcgccgccttcggcggtgccgcgaacaccagcgatgccggcgacgatgacggcgaggaagaagccgcaccgaagaagggtcgcggtcgtcccgccggcagcaccaacaaggccaagaccgaaaccaagccggcggccaagggcaagtccaagccgaaggacgaggaagaggaagaagaggaagacgacggcctcggtgacgacggcgacgacgacctcggcctcggcgacgaagacgaagaagtgacgcaggaagatgtcgtcaacgccttcaaggcgctgaaggccagcaagggcatcgacaagtgccgcgaagtgctcgcgaagctcgacgagtccaacgtgctgaacatcccgccgaagaagtacgccgaagcgctgaaggaaatcaaccgcgccggctcgaagaagtaattcggcctgcacgtcacacgaaacgcccgggttcgctcgggcgtttctttcggagagaaatacatgcccggttctcatgctcgcttcgcaccatcgtcggcgcatcgcatttacgattgcccggcaagcctgctgctcaacgagaacgagcccgaccgcgagatttacgaagcggccgaaggcaccgtggcgcatcacatcgcggaaatttgcgcacgcgcgcgccgcgagccggaagagtttctaggaatgacgttcgacagcggcgacctcgacgccgactacgacgaagagcagcattcctcgaaaggcttcgcgatcaccgtcgacgacgagatggtgcagggtgtcggggcatacctcgaccgcatcatgggtctgccgggcgaccactacgtcgagacgcgcgtcaacatctccccgtggtgcccgatccccgatcaattcggtacgtgcgatcacgccgcagcgtcgcacaagaagctcatcatcaccgacttgaagtacggccgcgtgcaggtcgatgcgccgcagaacaagcagctcgtgatgtacgcgctcggctttatcaacgagtacgactggctgtacgacttcgacgaagtaatcatccgcattgcgcaaccgcgtctcgatcacttcgacgtgtggatcaccagcaaggcggaactgctcgctatcggcgagaagatcaaggagcgcttcgcgctcgcgctgaagccgaacccgccgttcggcccgagcgagaaggcgtgccgcttctgcaaggtcaacttcaagtgccgcgcgaaccacgacttcctgtaccacgagcgcatcatgctgctcgatgacgacgacgaattcgtcgagcctgacctcatgctcatgagcgacgaggaaatcgcggcgctgtggctgcgcaagggcatgtacgagaaccgcatgcgtgcagtcgaagactacctgcacaagaaggtcgcggacggcgatttcgtgccgggcctgaagaccgtggcaggccgcagctcgcgctacttcgtcagtgaggtcgacgcggagctgctgctgctggaagccggtgtgcctgagtcgaagctgtactccaaacccgagttcgtgtcgcctgcgcaggccgaaaagctggtgcgcggcgaggcgaagaagaaattgcaggacttcatcaagtcgaagcccggcaaaccgtgtctggtctccgcagacgacaagcggaaagacctgactgttcagtcgctcgaattgctcgacgactgagcatcctgttgtacgaatgcgcgaaagcgaactacgaacgtcgaatgacgaaggagaaatcgaaatggcgaagaagaaagttggtgatctggtcgacaagggcaatgggcgttttctgctgaagaacgtgcgcctgagcttcccgtacttgttcgagcccgacgagcatgaagacgacaacggcaacaagaagaagtcgtatcgcgtcaccctgctgctcccgaaggcgacgcacaagcccgtcgcgcagaagctctcccgcctcatctccgagatgtgcgaggaagagtacggcaacccgaagctggcggccgaccgcaagttcctgcgtgatggtgacgagtcggatgtcgaagaccaccacggctgctggacggtgacggttcgcgagacccggaagccgatcctcgtcgaccgtgatcgtcagcctaccgaggaagacgacgagctgctgtacagcggcgcgtgggccaacgtggtgatccgcccgtgggctcagaacggcaagtccatgaagaagaagaacaagtacggcaagcgcatcaatgccggcttcgacatcgtgcagttcgtcgaccacgacgacaacctcgcgggcaatgctcgcccggatgtcgacgaggttctggacgaactcgaagatgacttcgaggacgatgacagcagcaccagccgcagcaagtccaagagcaagtcgaagggtcgttctcgcgacgaggacgatgacgatgacgggctcggcgacgacgatgacgacgacagcagctcgcgccgcagtcgctcgtcgaagagcaagaccagcagcaagagccgtcgctcgcgcgacgaggatgacgacgaagatgacgacgacctcggcatctaaaatcgggcatcggtaagcggtacctacggtcgcccgggcactccccgggcggctgtttttcagggatacggtatggacaagctgcatcacgacttcgagaccttcagcaagtgcgacctgaagaagcacggcttggcgcgatacgcgcgcgacaagtcgaccgaagtgctgttcctgtggtacgcattcaacgacgaagaaccggaagtctggttccccgcgacggagccgatgccgaagcgtctgcgccgcgctctcaaagacccgaacgtgcagaagtgcgcgcacaacgctcagttcgagcgcgcgatttggctgcacgttctcggcatcgacattcctatcgagcagttctattgctcgatggcgcacgcattctggctctcgctgcccggcaacctcgacgaactctcgggcgtgctgcgcctcggcgagaacgcgaagatgaaggaaggcaagtcgctcgttaaattcttctgcgggccgcgcaagccgaccaagaccaagcagtacacgcgcaacaccgagaagactgacccggcgaagtggaagacgttcgtcgagtacggccgccgcgacgtgatcgccgagcgcgctgccggtcgcaagctcgcgctcttcccgatgagcgacttcgagcgcaacctgtggtacatcgaccagcacatcaacgaacgcggcattccgttcgacaaggagttcgtcgagaccgcgctgcgcgtcatcgcgaaggagaagaagcgcctgctgggcgagatgggccgcatcaccggcctgagcaaccccggcagcggcacgcagttgctcccgtggctgcgcgagcgcggctacccgttcaccaacctcaaatcggcctcgatcaagaaggcccgagaggattgggattggaacatgaccgacgacgcgaatgcagtgctcgcgttgcacgccgaagcggcgcgctcgtcggtgacgaagttgcagaagatgctcgacatcgaagtcgacggagtgctgtgctacacgatgcagttcgcaggcgcgggacgtacggcgcgctgggccgggcgcgcggtgcaggtgcaaaatttgccccgccccctccgcgaactagaagaacaaggggcactgctcatggtgcgcgacgcgatcatgcgcgaagacatcgagttcgtgcgcctgctggtgtcgtcgccgatgggcgcgattgcatcgtgcatccgcactgcgatcaaagcgccgcccggctatgagtacgcaacctgcgacttggcctcgattgagtcggtcgtcatcgcgtggctgtcgggctgcgacaagttgatcgaggtctttcagaagaacctcgacgtgtacaaggtgttcgcatcgaagatgtacaaggtcgactacgagcaggtcgagaagtggatgcgtcaacacgcgaagcccggcgtgctcggcgcaggcttccgcctcagcggcggtatggagctgggcgagtaccccgaggtcatcaagaccggcctgtggggctacgcggagaacatgggtatcgagatgtcgcagaaggatgctgcggccgtcgtgaagttcttccgcgaggaatacaccgaaatcgtcgagctgtggtacgagctggaacgcgccgtcgcgaaggtgatgaacacgaaggagccggtgcgcgtcggcccgattctcatggacgtgaagggtccgttcctgcgcatgcgtctgccgtccggtcgctacctgcactacctgcgcccgaagatgatctggaaaaagatcaaggtcggcatcgacaagaagaccggcaagccgaagtacaagtcgaagaagggcttcacgtacgaaggctacaacacgaagaagaaatggacgcgcatcgactcgcacggcggcaagatcgtcgagaacttggtgcaggcaatcgcacgcgagttgctggccgccggtctgctgcgcgcatggaagtccgggctcgatgtccgcatgcacgtacacgacgaaatcgttgcgctggtcaagaagaagctgtcggacatctcggccgcaacgctcgaagagcagatggtcaagaagccgaagtggtggggcgaagatgttccgattcgcgcgaaggctgacgtagtggagtgctatcagaaatgacttggctaaccgactggcgaaacgtaatcaacggcaagccgccgcgcggcgacatcctgccgaccgacaaacatcgcgtcgaaaaggatgtggagcagaagtggtgcgccgttgcgaagcggcacggatggaaggcatacaagttctcgtcgcccggcaacagcagcgtccccgaccgcatgttcattcgcaacgggttcgtcttcttcatcgagttcaagcgccccggcggcaaggcgacggacaatcagctcgaagagcacaaggagctgcgacgcaaggggatgatcgtgtgggtcatcgactacttcgacaaagaattcgccgagtggatttttgaatgaaagaactactgaagcgctccgacctcgacgagtttcaaatcgctgccggcctgttcctcgaacgggtcggcagttgcgcgttgtggatcgacatgggcctcggcaagaccgtcgtcgtgcttacgcacgtctcggacaaggtgttctcgggcgagtggagccgcgtgctggtcgttggtccgccgctcgtcatctcggatacgtggtcgacggaagtaaagaattgggagcacacccgcttcctcgactatcaggaactcgacggcgacaccgagcacatgcgcatgcagttgcagcggccgtgcgaggtcgacggcatctcggtgcataagctcgggcgtctggcagcgttgttcaagcgcggcgataccgtgccgtgggacgcggttgtgttcgacgaatcgagcatgttccgcaacaagtcgtcaaagcgttggaagtacggcgtgcgcctgacgtgggggcaaccgaacgacgtgatcgagctgacgggtacgccgagcccgaacggcctgcatcaagtctggtcgcagattgcgatgatcgacggcggcgaga

SEQ ID NO: 18 - DNA, 56134 bp, Unknown
  Bacteriophage Xfas110
tcttgatgacttccgggtactcgcccacttcgccgccgccggagagacggaaacctgcgccgagcacgccgggcttcgcctgctgccgcatccacttctcaaccttctcgtaggggacgccgaacatgcgcgaggcgaacaccttgtagatttcgaggttcttctgaaacacctcgatcatcttctgacaatccgccagccagccaatcgtgaccgactcgatagacgacagatcgcaggtgacgaacatcttgcccttcggtgccttgatcgcggtgcggatgcacgacgcgattgcgcccatcggcgacgacacgaggatgcggacccaatccatgtcctcggccatgatcgcttctcgcaaaagaaggagctgccactgctcttccatctctcggagggggcggggcaaattttgcacctgcaccgcgcggccagcccagcgtgcagtgcggcctgcgcctgcgaactgcatcgtgtagcacagcatgccgtcgacttcgatgtcgagcatcttctgcaacttggtgacagacgaacgcgcggcctcggagtgcagcgcgagcacttcgttcgcttcgtcggtcatgttccaatcccaatcctcgcgagccttgcggatcgaggcggatttgagattggtgaacggatagccgcgctcgcgcagccagggtaggagctgcgtgccgctagtcgggttttcgaggcccgtgatgcgcttcatgatcttcgtgaggcgcgccttctccttcgagatgacgcgcagcgccgcttcgacgtatgccttgtcgaacggcacgccacgctcgttgatgtgctggtcgatagtccacaagcgctgctcgaacgcgctcatcgggaagcgggccatcttgcgtgcagcagcgcgctcggcgatcacgtcgcggcggccatagtcgaggaacttctgccacttcaccggatcggtgagcttggtgttgcgggtgtactgcttggtcttggtcggcttacgtggctggcagaagaacttcaccagcgccttgccctccttcatcttcgccgtcttgtcgtccaggcgcagcacggtggagagcgtatcgaggtcgccgggcagcgccagcgagaatgcgtgtgccatcgagcactcgaactgctcgacgggaatatcgatgtccagcacgtgcagccagatggcgcgctcgaactgcgcgttgtgcgcggccttcttgacacgtgggttcttcaacgcaaggcgcaggcgcttcggcatcatctgcgtcttcgggaaccatacctgcggctcttcgtcgtcgaacgcgtaccacaggaacagcacttcggtcgacctgtgcgtggcgtagcgtttgagaccgtgctttttcaggtcgcattcgctgaaggtctcgaagtcgtggtgcagcgtcgagtcgtattgaggcttttgcatgcgctggtctcagaaaaacggaagcccggggacaagccccgggcgaccgaagtagcactgtcaacccgaggaattacaggccgatgtcgtcgtcatcgtcttcgtcctcgtcgcgcgaacggcggcgggagttcgacggcttcttcgacgaggaacggcgcggacgctcttcctcttcttcctcttcatcctcttcgtcctcgtcacgagaacgacggctcgacttcgacggcttcttggaggaacggcgcgcggggcgttcgtcctcttcgtcctcgtcgacatccacgtcgtcgaaatcgtcgtccagctcgtcgagcacgtcgtccacgtcgggacgcattgcgccgccgagcggatcatcgtgcatcacgtgctggatgatgtcgaagccgcagttgatgcgcttgccgtacttgttcttcttcttcatcgacttgccgttctgcgcccaggggcgaatcacagcgttgacccacgcgccggaatagatcatttcatcttcttccatcaccggctgacggtcgcggtcgaccagcgtcgggcggcggctctcgcgaacgttgacgacccaatggccctcgtgctctgcgatgtcaccgtcgtcgccgtcgtgcaggaagcgcttgtcgctgcccaccttgccgccgtcgtactcttcggcgatgaggtcggcgatcaccttgtccaacttcttcttggtgcgtgcgccggtcgccttcgggatcagcaacgcggtgcggtaggacttggttttcttgccttcatcgttttcctgctcatcggggttgtgcaggtaggcgaacgaaaggcgagcgcctttcagaaggtagcgaccatcgcccttgtccacgaggtcgttctgcgggatttgcttcttagccacggtgttgctcctatcgttgtcgagactatcgtctgtcgagattgtcggttgtcgggattgtcgaactactacgtgcgtcagtcatcaaggagcgacaacttctgcacggtcaggtcttgccgcttgtcgtctgcggagaccagacacggtttgccgggcttcgatgcgatgaagtcctgcaatttcttcttcgcctcgccgcgcagcaacttctctgcggcgtggggcgaaataaactcgggcttagagtacagcttttcgggcttgatgccagcatcgaccatgagcatttcagcatcgagttcgctggtgaagtagcgcgacttcttgcctgcaaccaccttcaggccgggcacaaactcgtcgttggcgatcttggtgtgcaggtagtcggcgatagcgcccatgcgcttgtcgtacatgctcttacgcagccacaccgccgacagctcttcgaggctcatcatcgtgaggtcgtcttcaacgaagtccccgtcatcgtccagcagcatgacgcgctggtggtagaggaagtcgtggttggcgcggcacttgtactgcaccttgcagaaccggcacgccttctcgctcgggccgaacggcgggttcttgctgagcgccagggcgaagcgcttcttgatcttctcgccgatagccagcagctcggccttgctcgtgacccacgtgctgaagttctcgacgcgcggctgcgcaatgcggatgaccacttcgtcgaagtcgtacagccagtcccactcgttgatgaagccgagcgcgtacatgatgagctggaagttgttctccggctcgacgaagatacggccgtacttgaagtcggtgacgaccagcttcttgtacatggccgctgcgtggtcgcacgtgccgaactgatcggggatcgggcaccaccgcgagatgttcactcgctgctcaacgaagtggcaccccggcagacgcatcacgtaatcgagatactgaccgacgccagcaaccatctcgtcgtcaacagtgatagcgaagcctttcgaggaatgaagctcttcgtcgtagtcggcatcaaggttgccgctatcgaacaccattcctagaaactcttccgggtctttgccggtcaacaggcaggtctcgccgatgtgatgcgcaacggtgccttcggccgcctcgtagttctcgctgtccggctcctgctcgttgagcaccaagctggccgggcagtcgaagatgcgctgtgcagacgacggcgcaaagcgcgcatgcgcacgcactgcttccttgacggcctttgcgagtttgttgcgacgtggcttcatcgtgtcctctcgaaagaacgcccggcatcgccgggcgtccgtgttacgtgcaggccgaattacttcttgcggctggccgcgcgcttgatttccttcatcgcttccgggtacttcttggccggaatgttcaggacgttgctctcgtcgagcagggccagcaccttcttgcaggcgtcgacgccgtggctggacttcagcgccttgaaggaggcgaccagctcttcctgggtcacttcttcttcgtcgtcttccaggccgaggtcgtcgtcgccttcgtcctcgtcgccgtcaccttcttcttcgtcttcgtcgtccagcgggtcgggcttcgacttgcccttgcccttcggagcggccttctcggccggtgccttcttggtgctgcccgccgggcggccgcgaccgcgcttcggcgcttcttcttcgtcaccaccgtcttcggattcgttgacggagctgttgctgctggtcccgcccacggcttcgatgatgagaacgatggcggcggcgagcttcttcgcgttgatggtggacatcggtttgttgctcctagctaggttggttttgggagtgacgggcggattgcaattcctgcccggcgagcgcactatgcgcccgtcccaacgctaagtcaataggcacgcaaagcggcttagcagaccccttgaaacccacacgccgcgaggattccatgcgccgagacctaacccttgattcactggacagcgccgacgcgcgcgtccgctatctactccggcgcatcgccctaatgctcgacccgccgtacggtcggctcaacgcaatctgcgagaagtacaactggcacgagaccaccgtgtcgcgttggcaacgtctcggatgcgtgccgcgcgacaaggcttcgatcttgcacaaagacttcaaccgtgagattggattcaatctcgaagacctcgttggcgacgacatcgcggagtgacgcacatggctggacgaccgatcaccagcgtgcttcgcaaatacggcgcgcagttgctcgaaaacggctactccatcatcccgattccgaagggacggaaaggcccaatcgagccgaagtggcagcatattgaagcaacgccgaagctggtaaagaagtgggcgagcggcgactacacgcagggcaacatcggcttcttgacgaagcacacgcctgccgtggacatcgacatctacgacgccgagatggccgagttgatggccgagcacgcgcttgaaatctgcggcaagacgatgacgcgtgtcggcatggccccgaagaccatgctcgtgtaccgcaccgacatcccgttccagaagcgcaagatcaccttcgtcgacgaagaaggtaccgagcacgcaatcgaagtcctgggcgacggccagcagtttgttggcatcggcctgcacccggagacgaagaagccgtaccgctggacttccggcaagggcatgaacccggtgagcgtgccgcacgacatgctgccggaaatcacgaccgacgccatcgacgagttgttctcggtcttcaagctcgaagcgcagcgtcgcggctggacgttgaagaagcacaacgcaccgcgcgatgcgagtcgcgacgacatcgacgacgagaacgaccgcgcactgctggcgcacaagcagccgctcgaaaacctgaccgccgatcagctccgcgaggtgctgcaatgggtgccgggtgctgacgactacgagcagtggttgaaggtcggcatggcgctgcaccatcaattcgacggcgaggaagagggcctgtcgctctggcacgagtggtccgaaacgtcgagcgaatacgacgccgactcgctggaagaaaagtggaacacgttccacgatgagatgggccggaacatcaccacggccgcatcgctcatcaagatcgcgaaggagcaccggcaggaggtcgccgaggaacagttcgagaagatcaagcgcaaggtacatgagaccgaaagcgcgatggaacttcttggcccgctggcgaagaagtggggccggttgatggagcacgactatcaggccgagctgctggtgggcgaaatccagaagcgcgtcaaggagctgaccggcaagtcgccgagcatcgcgaccgtacgcaaggcggtgaacgagggctaccgcaattccgacttcaactacaaggagctgccgttctggtgcaacgacgtggtgtacgtcgacaccgaggaagagttcttcttgatggagaaccgcgtcgcgctgagcgagcgtgcgttcaacgcgcgcaacaaccgccacctgctgtcgaagaaggatcgctcgaacatggacgcggtgccggagcagcaggcatcggccctggcgctcaacgtgtatcaggttccggtcgtgagcggctacgtgtacctgcccggtgccgagcgaatcgttgaatggaatgaccagaagcacgtcaacctgttcaacccggaagacatcgtgccgatccccgagaagatgggcggcaaggcgcggcgtgcggtcgaggcggtgaagcgtcacttcgagatttcctacccgatccagcgcgagcgcgagctgctgctgtcctggctggcgttcactatcaagcgcatggacaagaagattcgctgggccgtggtgatgcagggtatcgacggtgccggtaagggtttcgtcggcgaaatgctcatggcgatcctgtcgaagaacaacgtcatcaccgtcaacgcgcaacgcctggaagagaagtacaccgagttctacgagcgcaacaaggtcgtcgtgttcgaggaagcccgcatcgccggtacgtcgcgctacgccgtgatggacaagctgaagccctacatcacgaacgacgtggtggacatccgcaagatgcacagcggcggcttcaacgtgccgaacgtcagctccacgatcatcctgaccaatcacagcgacgcgctgccggtgtacgacgccgaccgccggtacttcgtggtctcgactcacttccagacgaagcagatgatcgagaagttccgcgcgcagcaccccgaccactacgacgacatcttcaacgccatcgcctatcacgcgggcgcgctgcgcgagtggctggaagactacccgctgcatcccgagttcgacccggacggccacgcgccgatgacggacgccaaggaacgcatgatcgacctggctcgcggcgacgacgaagacgagctgctggaaatcatcaacgagagcaccgacccggaagtcaacaacatgctgctcaacgtcggcaggctgcgcgacgcggcgctggatgcgtcgtgcggagttccgttcgggccgaagctgtcgaacttcctgaccgccaagggcttcgtctacgttggccgggcgcgcggtgcgagcggcaagctggcgcgctattggtcgaagcatcccgagctggtgatgaagccgaacctgcaagcctggatcaccgacttcatcgaactcgcacgcatcaagatgtaacctacaaccgcccaatccagggcacaggagaaacgcaatgaccaccaccgtcaaactctcgtacgtccacggtaacaaggcgctcgccgtcaagctcgaaggcaacagcgtcggcgaactcggcccgggccgcagcatcgaagtgagcctgcactcgggccagcagctcaccatcgacgagaccggagagttcttcggcagcaccaagtcggaagtgcagcagccccaggccaccgtagacgaagccacgaccgacgccgctgcgtacgaaggccgccgcgatctgccgccgggcgctggcgaacccggctcgaacgtgccggacacccgcgtcgaataaacgcacaccggcagcgaggcaaaaagaaacccccgggtcgccccgggggtttttcgttgcgccgaattagccgactcgatcctgccatgccgggtccggcttggcctcaatgcgcaatttccacccgaaccacatcgcggcaatttccggccgccggtacgcgcctttctttttccgttccagcagggtcgccttgtcggccactcctttttttcagcagcagggtgcggctgatctgcgacacgaaatatttcttgtagacggcttcctcgaagtcagcgcgcgtgctctcaatttcgtcggtttcagcgatcatcggcatttctcggtgtgccggacgaatttccggcgaattaattatcggcaattctttccaatcgcgcaaggtactgtcacaagcccgggaattaactccttgtgacactgacgaattaatttgggccgatgtggcgaaaaaagcgtcactgtcacaaggtactgtcacaagccgaaacccttgtcctgcctacttttcctcttattttgtgacagtagtgacagtagtgacagtaccttctgctacacgcaggaatacgaattgtccctcaaatattagcaatggtactaatttgtggccgtttttcgtgttttctttcccggtaagggagaaggtttcagtgtcacagtgtcacaaaggcccaactcgcagtagcaaatcgacctcaaaacccttccaaatcaaccgtttgcgcggggggccgagttgtgacagtaccgcaaatcgtcagtgtcactactgtcacaagcgaataaattaattcctagcccggaaatgcggtgcagcgcgcggttcggccccttataggagacggaaatgcgaaaaaattgaaaaatgcgcgagcaccggggtcagcgccccccgcgacgcccgcgccagggccggaagtacctttttactcgcatcgccgctatcccttttaccctcctgcgccgccgcaatgcgtgcgtgcgggccgcgcggccatgcggtgatgcgaataaaagggaaataaatgcaatgcgcacacgcacgcgcacacgcgcctctaggcccatgcaataaattaaatgcgtgcaatgcgggaaatgcccaggtgcagggctatcgggtgtgccgcaggtcgaccacaaatcagcaggacgtgcgcccaggtgcaggccgttagcgagtcagcaggacgtgcgcaatgcggaaatgcgcaaatgcgggcgcgcaggtgtgctcactgcgcaggccatagcgttaccagggaaaggcgcgcccaagggtaggcggccagggcgagcgcccagggacagacgaacgcgcaataaaaagcccccgcgtgagcgagggctagacagtggcagacgtgggggtgtgggggtgcggggttttattcgtgtggcttgtgccgggcttcgatgtcccgcacctgcgccgcgtagctgcggccgtgtggcttgacgtgccacgcgcaggccacgcccagggcaagcaccacggcggcggtgatcgcaccggccttgtgccacgcctgcactgccagcggcaggacaagcgcgcccaggatcgccaggaacgcaacccactgcacaaggcgcagcagactatcggccagaatgtttgcgcggatgattttgcgcttttcggtttcggtcagtggttccagggtcatgcgtcaatcctccttcaccacgcgcacaaccggcgtcgtgtccaggccatacacggccacgccgcgcgaggtcgacaccttgacgcccaggcggcgcgcggtgagcgctagcgacgtgtcgcgttcgtgcggcccttcagccacgaatacgcgcgccttggggtcagtgctgcgcagccaatacgtgtagggcgtcacgcctgcggccctcccgtgtagtgctgcacacgcaccggcagatgcggatattccgcctgcaaccgttcggcgtgctccaccgctggccccttgtcggcgtaggccgcagcagtcgaccaattttcagtcggcttgaactgcaccgcccaggggaagttagcgcggcccgggcttttgacaatgcgaacgctcacgggcgcgtctccttaaacagttcgggcgcggcgtctgcctcatcgcccacgccatgcgcataagcgcgcaggcgagacacggccacgcggtcggcgtcgcgcagtcgctcgaactgacccgcccgcacttgcgcatcatcgttgcgcaggatgtcggcgcagcggtcggccagggtgtgacacatgacggcaaacggcattggcgcgaacgtggcgctatccagggcggcgcacgtttccacggcgaaggcgaacccctccaattcctttgcgcggttgtgcctgccgcgctcgcggtggatgagggcctgcgcacgcatggcgagggcgagacgttccagggaatcggccatgtcggtcactccttttcgcagcgcaaaggcgcgccggggttgtctaccagggcttgcacgcaatcgcctgcggtcaggccgctatccatgacgaacgtgtgccgctcgccgcccaggatcaacaccaacacaagggagaaagtcatcattagcgcacctcgaacgtaacgcgggggtagctcttgcgcgcttcttcctttgcctcgcgttgcgttgcgaagcggtcgacgcggccagtgttgtgcagcagcaaccacggcgtttccggcgtgtagccgtctgcggccttatgcatgcggttgattgaggcgacgtgttcgccatgcgacaggacgttcatgcggtgcgctcctcgtggatacggcggcccatgtcgataatcgcccatgcggttttttcgtcaatgtcgtgatgcgcggcgaaacgtgcaaccgtcaaaaacgcattgaggtattccaggtaagcggcctgcaacgcgtcgcgcaggtaaccgtgggcggggttgtcgatattcattccttcaccctccacgaacgcgaaccgctcatgtacaccgcgccgtcgccgccatacagcatggccgaaatgccgtgcatcacgttgtccacgcaatcgctcgcaacggtggccgcgtagtcgccattatcgtccacaccccacagcgaatccgtcgcgtccgtttcgttgccttcgatgtccagcaacgtcaccacgacgccgatatagctccattcgtcattgcaccatgcgcgaaggtgttcgtaatcctcgcgagcggcgagcgcggcaatctggcgcttactcatgccctcttcagcgccacgcgcgccccagccgtcgcgcagcgcgatgcggcacgcgtcggcgaagtcataaaagcgtttgctaccgtgatcggtgttcaacaccaattcgcccggcgacttgtcgcgcgtagtccagtcggacacggtgccgtgaccatcttcgttttcccagggtgcgccgttgtcggtgtcggcgcagtgatcgacgcggaacgtaaggccgtcgcgttccagggtataggagtggataacgtcgctcatgattacatgccctcgaacagttcgtgaagctcgcccatcgccttatcgccgaacgcggcgcgcatcttcagcgcatcggccatgcacgcgtcatagatagcgcgcgccttgatgctgtcggaatcaaatccgtaatcactcgcccaatcggcgaagtcgcggcaatccaacacgcgcgagtcggacaggaggctataaaacacgtccaccaattccggctctagcttgcggccgcgcttgaactggccgcccatcattccgcccttcgcctcgaaccccgtatcgcattcctgcgcaatggcggcgcgcttttcggttttcgggttgacggtcggcgtgttgaaattgttgcgctgttccgccgggcagtgcccgcaaccttgcatgtaatccgtcgtcaacacttcgcggtcgcccttcttcagcgtcacgcgccagttaagcgacggcgatttttcatctttgttgcgcgacgcgtgaaacggcacaaactcggcgctcatggtcacgcccatctgttccaggatgaaagcgcgatcatcgcttagttcatcgtaacgcgagccttcgccgggcatgtcgtcgtcataggcgggcgcgtagtgatactgaagcgcgcacaactcgccgtctttgcaaagcgaatcggtgtagtcgttccacgattcggccagggccgggccgtcatccttcggaatgtcggcggctaactcctgccactgtgcgaacgcttgggaaagggaaatggtcatgtgtgcgattccttagacgggggtgacggtgataaagcggggcgggcgcacggtgtagccgtgcaagcccagggcgtaattgcgagcggtgcggcggtcatcggcgtggacggtgaacaccggcacgccagggagcgagataaggaaagcgcgcattagatgaactcccggacaagggccgcgacgcgcggcgcgtagtgataggcggctgcggcgacgacaacccacgccagccagcccaggacgcgcgacacggggagcgaggcgcgaggcttgcgcaccggacgcggtgcggtgctgcgcgcagcggacaggcccgcgtgcgcgtcatagtcggagcgactgcggcggctcatgcctgcaccagggcgttaacggcgtcgccagcggccaggatcacgccagcacgattgaggcacgctttcgtgagcatgccgtcggcgtccgtcgtgatgctcacggtgttgttctggatgatcgccagataggcataaccgcacaccttcgccattgcagcgtcggcgatgccggattcatcggcggcaccgaacacgcccaggaacgggcgacgctgcgccagggtgtcacgggccagcgccatagcacggtcggcggctgcgcgaatctccgtatcggtgacaggggtagcgatgtcgtgggccagcttggcaaccacgttgcgaaccgcgccgccttcgcgcacgtcgtcggtggcgaactgcgcggacagtgcgaaagcggcggcgctgtcgcgttccatccgcatgcgcggggtgacgccggtaaagcgcggttcgtcgtcgcgcttcataccctgatcccagccagcggcaaggcgggtgcgctgttcgatgatcgaatcagccagggcggcggcttcgcgaatggcggcggtgcggttcgttgcgttcatggttgctttccctttgttagttgccggggcggtgttgcctgccggtggaagaattacagcacccctcgcgcagtagtgcaaatactttttttcaattatttttctgaacggcgttcagcgcttcccaggatgagcgacgcggccaggagaacgaaccgcgcgcggcgcgcgttcattgacacgcgcccgcaggtgaggcgcgtgacctgtgcaggagcgcgggcgggtgtgcgtgcaggtgcgtgcgcgcgtccgcgtacacgtatgcctccggtacagaaaaagcccccgcttcggaaagtcagcccgttccaaaaatccacggcaggccgaaaccgaactcgaaagccagcgcgctctcgcttcggagacccagccggacccaatttttctcccgcttcggaaacccagccggacctttgtgcagcagggcggccagctcccggccggtcacgaccgagaaccgggcgcttgacaactgcccccggccgcgcagtagtatttgtcctgtccctttactccaaccacggcacaggagattcgcccgatggcatccgccagcaccaccagcacgaccgcccccaagaagccgcgcaagatgccgaccaccgtcaagaaggaacttgcggccaagcggaagagcaccgccgccaagccgaaggtcgccaagccgcgcgtcctgttcctgcccggctcgctcaacgaccagatcagcaagctcaaagtcggcgagtcgctgggccacgtgcgtcgattcgtagtagagaacggccccacgctgtcgtcccaggcgcaatcgttcttcaaggcgaagaactcggtgctgtccggcggcatcgccaaggtgcgcagcgcacccgagcacgcaagcaagcgcttcacgatggaacgcggctcgtacatgacggccagcaacgacgccatgttcgcgttcctgaccatcactcgcaccgagtaacggccatgcgcaagtacaccgtgatggaattggagaagggcaaaatgttggcccaaagggtttcggtttttcagaatgcccgagtaccccctttgtctcgcgcgcgtgctgccaccaccctactgctcgctgcaatccgtctggccgcatggcaacgcatgcgcctgctctcccgctggctccgcgacaagcaggtgtgcccggcgtgcgagggagccacgcagctccgcgacaactacatccgcatctgcatgctgtgccacggtcagggtgaagtgacgtggcgcgaggtcgaggcgcagaagtggggcgcagcactcaaccgctacatcgagcagaacaaactggatcacagctacttctggcccaggctgacgctcaacgacctccactggcacgtcaacggctggatgtcgcttgacgattgggacgaagagttgctgggcatggccgacctgcaactcgaccgcgaagccgcaggccacgtaagcaccacctaacccaaccaaggaccgccgatatgtacgataagcagttcaccaacaacgcaccgaagccggtgcttctgcccctcatcgctacctgcaacgacgagggcattgtcttctctatccaccgccgacgcggctaccacatcggcctggatgacggtcaaatggccgaggctgagcgcatgttccagtgggccaaagtcacgttcaccggccaggacatcgtgatgttccaatcgcacaacggcgtcgtgccgtcgccgcagccgggcttccactccggcggctttacttctagcttcggtcagggcaagagcgaagcggcgttccgagccacgtcggggcgcgacctgttcccgggcactcagctccacatgctttccggcagcatagacttcctgaaggacaatgaccgtcgctatatcgtgctcgacgacatcgacccgcacgccatcgctgaagccatgctgctctcgccgggcattctcgacctgctgcgcgtcgacctgctggacatcgaagcgcgcacaggcaagaaggaagtcaacatcgagctgcgcgtcgacactggcgacgtgatcggcgacctcgaaaagtgggccaagaaggtcggcatggagagcttcgaccaacgtgtctactcgaagaactacaacgaaggcccggcgttctcgatcaactcctactggcagagccgcactgagccgacgaagttctaccgcgtgaccggcttgcagcagtgcgtgcgccactggcatgtcgagatgcactgcttgcaggacggcgagccggaagatcgtgtgtgggaaagcacgcgctcgtgggctgacctcttcacccctgtcgaccgcgagaccgccctggctccgctgtcgccgcagagcagcgtcggcccgtacgcgtaccagctcgacgcccaggcgttcctgcggtcggagcgcgcgagcggtgtcgaggctgagtttgtcgctgaagccgaagcgccgaggaacgttgtcgacgccacgcagcaggtgcttgacggcgtgcccttccacggcaatgagctgccgccgaaggtcggcgagcagtaccagcgcgtcggcagcgagcacatctacacggtggtcgacgtgcagcagggggacttcaacacgcacacggtgacgctggacacgcataagggcggcgtccactacggtcgcaacaagcacactttccgcgatcatgcacagtggctcgcgaaatggcgtccgctcgatagtgagggcaacgtcaagccggttgtctacatcgacatcgagaacgacaacggcgcggtgatgcaggaagtccgcgaagacatgctgacgcacaatgagggcgagaacgcggtgcgttggattcgcgtcatcggccgcgagctggaccgtcgtgtgccgggttggcgcgactacgatccgccgggcgtgctgtacgacgactgcgcgctcatcatccgtgccatccgcacgctgttccgtggcggcgtgcaggtcgaatccgagctgattgccttcaaggattcgctgaaggaagtcgaagccctcgcggagcagcgcctcgccaacgtcgagaagcgggaccagcgcatccggcagatggaaggttggatcggtgagatgtcccgtgacgcctcgcgtgcattcaggaacacgttcggccgggataagggcctcgaagtgatgaaggagatgctgaaggagttcggccatgcttcgctgctgtcgatccctatcgaggatcgcgtgagctgggtgcgcaagttgagcgagtacacggcaaaggcgggcatcccgtgaaggtgcaatacgaagaaatcggcgatccgactgaaacgggggtctacgcagtccgcgtagatcaccccaaggtcgtgaacctcgtcgtcgacgcgttcctcgtgtggtacgagggccattggtactacctgggaagcgaccagcagcatcgcggtgaagtccacggttgggtcggcccgctgccccgcatccgcccgctgcgcacaaacgtggagctgccgtaatgctcgaactcgaagccttggaagacgtgaccgaagccggtttctacatcgtgcaggtttgcgactacccgacgatcaacagcaagcgacgcgcgtaccacgtcttcgagttcaacgaccgcttcgggtggttcgagacgctgcacaagtcgcgcacctacactcagatttacgggtggtacgggccgctctcgctgaacgacatggaagtgctcgacgacccgagcgagatgggctactacgcggtgctgttgcaaccgtggccgggccagtcgccgcactacaagcagttccgcgtctgtgtgtggcgtcgcgacgcttggcacgatcagtacgggttcgccaagcagtacggcaacgttatcggttggctcggcccgttcccgttcctgccggagacgcattggctgaagcaacacgagaaggaagaagcggaggacatcgggctgtgagtttccgtccatccaccggccgtaagatcacggtaaagaagaacccgaagaccacgcgcgacatcatgcgtcggcacctgcgggaagagggcaagcgaatcgtcgacttgtgtgacgtgtgggacatgcacccgaacagcgcgtaccgcaggttctacgacaagcgcccaatgacgccgcagatgatcgatgctttcgtgacgctgctgaagctcgaccacgaggacgcgagcgagctgcggctcttcgctgcaatcgaagcgggctggcagctcgaccacctgaaggaaaaggccgcatgaagtacaagcgcatccagccataccgcgacgtgttcattgccgagctgcacagcgagcaggtgcgcagcgacggcggcccgctgatcgtgctcgacggagtgggcgtgcatgtcgcctactacatcgtcgacgagttcggcgaagtgctgcatccgatccagggctatttcatctcgccccaggtcgcaatcggtgccgccgacatcctgctcgacacgccgaaaaagttcggccccaaggtttcggctctcatccgggccgagaaagatttccacaaggagttttgacatgaacgaccactacgctggactcgcaggtcgggtcagctttgagaacgtggcgggtgcccctatcagcgtcatttcgggctacaccgtcgaagccgtccgcgacatgtcgcccggcgactggaagacggcactggcacgcaagatcgacggcatcaagaagggcgagcgcgccaccatcaacgaagtgtggaacaacatggagggcacgtgggtgagcatccgcatgtctgacggtcggaatatcgacgtgagggcggctggtctgaagctcatcacgcccgagatgctggaaatcgaaaagcaggagaaggaagaggccgacgaaagcaacgcgatgctgttccaggcttgcacctatcaggccaagcagggcgacgactggcggatcggcatcgcacgcgtgaagtgtttcggcgtttccgacgtgtcgtggatcgtcgacgcggccacgggcgagaagcacaagagcatgtgggactaccgcctgacggaaggcgcgtgcaagcacatcacgacgagggttctgtgatgcgagtcgacatcacgtttaacggagcgccgccgctgatcttccgcaacgccaagagctgcacgttcgaccagggttgggtccacgtcaccgaccagaacgacggcgagcattctttccccgcccacgacatccgcgttgtcgaaaagacgccgacgcgccgctactaggagaaacaccatgagcgacatgcaaaccacggacgacctcatcgcgatcatccgccagcgcgccgaggcagggctgaagaagtatggcgtgagcctggaccgcaaagacctcacggcggcacagtggttgcggcatctgctcgaagagctgtgcgacggtgcggggtacgtgctggcggccgaacgcaaagcagtcgagaccgaaaccgcgatccgcgccgccatccagttgctcgtgctcggcgacgcccagggcgcggccgacgtgctcgccgcatgcctgcctgacggggacgccgatggtgagcctgtcgtgctgatccgagacgcaggcggcgcatgagtgaccgcaactacgcggccatgcgcgccgccgcacgtgacccgccgcaggcgtgcatgcatgccgccgccaccgcagacccgtacttcaacgagagctttccaatgcccctcccgccgcccgagaagcgccgctacgaacacatggctccttaccggggctacaccatcgcgacgtacaaggacatgctcgatgagccggtctacaccgttgagggcgtgccgatcttcgcggtgtacttcgcgctcgatgagttcggcgactccatcacgccggtcgatacctgcttctggtcgccgttcctggcccgcgcgatgatcgacatctacgtcggcatgaccgagggcgaacgcaagacgtggtggaagcggcaaggcgcgtggccgatgatccaccagaactacagctcgcaacaccacctgccgatgctgctcgacgtaatgcgcggcatcgcagcggagtgctccgaccctgacctcgacatcctgttcggcgatgcgagcgagttcggcaagcacgtggaaaagcgcatcaaacagggtctcgacaccctgcacatctcacccaaaccggagtaactgcaatgcccaaatatcgcatcgtgaaagacggccgccacgttggtgacatcgaagccgaggacgcgcggcaggctggcccgctggccgccgagaagtggggcgacggcatgtacgacctgtcgctgatccgcgaagtcgaagacgacgaagaggccgagtgatggacgcggcgacggcgctctggattctctcgaacctcacgctgttcgcagccctggtcgcggagaagcatcgcaaccggaagtaccgtgaggcgatccacgggttgctcgcggacgagggctacgtcgaaggcgagccgcaggcgtacatcaacgagacgctgcgcatgacggagcacatcggcaacccggaaccgagtgctcacgacttcgcgcacgccctggtcggccagaaggggttccgcaaggccatcgcacacgaagagctgcatcgtgtgtacctcgaaacgtacggacggggcgcacgcaatgggtgaactgccgcgcgtggggacggtcaggctctaccggatcgacggcgaagagatgaccttcgaccagattcaacgcaactgcccgcacgtcacggaaaagatgctgcgggaccggctgttccgaggggagcgaaagatggcccggctgagccgtccgccggattcgcggaggggtgttgacaagccccggagctggcgatagagtggccccgcagtagcgattttacttcggactccccaccgggtaagatcgagctgcaacgagacgggccgaggccagtctcccggtagcacggaagcgcgccccctcgcgacgaagtgcaaacccggcgtccggtgccacgatacggcaccccataattctcacgccgagagacaacatgaaaatcgaaatgcaagacctgccgaaagtccgcgacgcgctcgacaagttgatcctcgatcagcacaactaccgcaacctcaccacgcacggcgaaccggaagacaagctgcgcgtcgtcggcgagggcggccaccacgagggcgagctgacccgcgaagagctggccgaaatcttcgagaagcgtatcgaggaaaatctgaagttcctccgtcagcgctaccagatcgacttcgcccccgcgccgcagctcgtcactcgtgcggttccggctccgaccggcggcctgaccgaagccaacgaaaacgatctggacgccgaatgaactaccccgtcatcccgaggatcgcacccatgactgcaccgaaagtctcgcgtcgcttctacaacgcgctgcgcctgctcggcctctggttcctgttcgtcgccgcgttcaagcagtacgcgcgcttcatcaagccgagccgcgtcatcaccctggatggcgtcaacggcggcgagcgtcgaccctacctgacccgctggcacctgatcccgcgcaaccgctggctcaacctgtacctgcacaagttcgtccacggtgacgacgagcgcgctctgcacgaccacccgtgggccagcgcctcgctcattctcgaaggccgctacatcgagcacacgagcgagtggttccctgcgttcgataacaagcagatgggcgcgtacgtgatggcgatgagcgacctgttctcgccgcaggacggccgcacatacgtcgagggcagcgtgaccgtgaacagcggcttgcgcgaaggcgagaaccgcttcgactacacccagcagttccacgctggcgacttccgcaagctgccgccgacgcacatgcacatgatcgagctgttcggcaacaacaccgagccgtgctggacgctgttcatgaccggctcgattgtccgccgctggggctttgcctgcaaagacggctggcgcgacttcaaggaatacctgcaagacagcccctcgcaccctggctccacgctgggctgcgagtaaccgaatcccgcaagggaaccctgctcgcatcccgcgagttgtcgacaacaacgcaatggagatacccgatgagcgccaccgctgaagcagtgaccgaagcaaccaagaaggcggcgaagaaagcccccgccaagaagaccgcaccgaagaagaccaaggccaccggcacggccgctgccaagccgcgtgccaagaagctgatcgccgccaagaaggccgtcaagaaggctgcgccgaagaaggtcgccgccgatgctccgaagcgcggccgcccgccgggcaagaaggctgcgaagaagaccggcgtgcgccggggcaagaagggcgcgaagcagttcgcctacctgctgctgaccgcgcaggaagacggcacgcagaaggcaggcggcatgcagggtccgttcatcaccgaagccggtgccctggaagacgcgagcatcatggccgacgacaacacgaccatcgtgctgttccgtgagaccaagcgcggcaaggtgcagaagcagaccaagttcgtcgccggtcgctaagtcggccttgaccgagtagtacaacgagcggccctgtcgaataccggccgggtcgctttttcatatccgcagcaaggacactcatgaaagccgacatcaatatcaaccgcagcctgcgtcgcgtgttccgcacgtacgacaaggagaagcagctcgaagcgcaggggaaggaactcagcccgtggcgcaagaagcagctcgcggcagacgagcgccgcttgttcgagttgcagcagcgcgacaacgagaccgacaatcgcgccgacaagcgcggagtgccgggcaagccgggcaccggcatcttcgccacccgcgacaagggcagcgtcgaagagaagctgcgcaaggcgttcggcggcaaggtcgccaagcgcatcttgcagcgtgagcgactggccgctcgcgagcgccccgaccacgtgcgcatcttcgtcgagcaggtagtcgacggcgtaggctcgcgtacggagctgacgcgcggtgtcgacttcgcggttgtcccgccgccgcacggcgagccgacgctggtgctgcacgacgacgcgaaggtgttcgagattgagtacgcctccgactttccccacaccctgacctgagagacccacatgagcactctttctctgaagcgggaagaccgactggccttcgtcaacgccgcccacgcagcggccgcaggctacgccgagttcaccgagaccaccgcgaagtatccgaccacgctcagcaccgttgcgatcactgcgggcgtcctgtacgtcgccctgggcatcggcaacgaggtcggcgaactggccgaactgttcgacgaagaagcggtcaagcccgactaccgcgccgaccgatacgcgaaggcgtggaaggagctgggcgacgtgcagtggtacatcgcccgcatgtgcgaagagcagaagggcctgccgccgttcgccatcatggtgcgcaacgcagccacgcgcctcgccgacgcgcactaccgcgaagcccggatcagtggcttcgatctgcaatcggcgctctgcactcacgcgggcatcgtccagggtgtcgtcaagaaggccatgcgcgacggcatgcagtgggacgaggccaaggccgccgcgaagctggaagaaatgcggcaggcattgcagcagatggtcaacgtctcgttcgagttcgccgagcgcaccgcacccctggtcgactgcggcagcggcggctacgtggcgttgctgaagggcaaccgcgacaagctggccgaccgcaaggagcgcggcgtgctgcatggggacgggggcgagcgatgagcgcgcgggcgtatttcatcggcggccccttggacggccagcgcctcctgttcccggcctcgccgccgcagctctactcgcatgaagtcaagcaggaagagctgcctgtcggcgatccgaccccctcgcaccggttcgagtacgagaagcacttcttcatggatgcgatggacagcaccaccgtccatttctacgtgccgctgggcaagggcgcatcggccatgcgcgatttgctcgaagcgcggctgaaggagaacgccgatgggtgagtaccacgacctgacgatcatgctgagcctgccgcgcagtcgcagcgcgtggatggaagcgttcgtccgcccgggcaccggccacggctgcgcgtctctgcacaacccgttgcagcagtgcgcgtctatcaacgagctgggcctggttgttgacggcatgccgcccggcccggctttcatctccgacgtggccgcgatgttctttttcgaccatctcgtcgtgcggttccctggcgcaaagttcctgatcgtccatcggcctgcgcgcgaagtggcgcacagcatggagaccctgggcatcacgccgccgctcgatctgcgaaaggccgagaagcagctcatcgaaatcgccagcagcatccgtcacaacccctgggtgcttaccggcagtttcttcgagctgcataacccgtcgctgctctcggccatctacaagttcgtcaccgggaaggtcgtagagccgcgccacctgcacgcgatgatgaagaccaacgtgcaggtctcgctcgaagaacaaatccggcgcactgacatccagaagcagcgcatcctgttcggcaaggccaagatcatccactaggaggcaccatgaaaaccatcggcagcttcgcaggcccgtatcgcttcctctcgaacttctggtcgtgcgctgtcgttttcgacggccactcctaccggacggtcgagcacgcgttccaggctgcaaagaccgacgacatggacgaacgtcgacgcatccgtaacgagccggacgccgcaggcgcgaagcggcgcggtaagcgcgtagtgctgcgcgacggatgggaagagaacaagatcaacgtcatgagaaagctgctccgccagaagttcggcaccgagccgctgaagtcgaagctgctgaagaccggcaacgcaaccctcgtcgaaggcaattggtggggcgacaagtattggggcgtgtgcgacgggaagggcgagaaccatctcggcaaactgctcatggaaatccgcgaagaacttcgcatcgaaaaggaacagcacaatggctaagcgtattctgatctgcggcctgcccggctcgggcaagtcgaccttcgcgcgggaactcgccgcgcgcctcaacgccgctcacgtcaacggcgatgccgtgcgcgaggcggcgaacaattgggacttcacgctggaaggccgcatggagcaggcgcaccgcatgcgcgctgttgccgacacgcacgaaggtctggttgtgtctgacttcgttgcgccgacgccggagattcgcgcggtgttcggagcggacttgaccgtcttcatgaacacccttgccgagagccgctacccggacaccaacgagatgttcgtgccgccggagaacgcggactacgtgaccgaacgttgggcggacacgaccgagatgggtcacatcgccgaggcgatccgcttcatgatcccccagggtctcatgatcggtcgctaccagccgtggcacgcaggccacgcggcgctgttcgagcaggtgctcgcgaaggaaggctacgtcggcatcggcgtgcgcttcatgccgaacggcccgagcaacccgctggacggcgtagcggtcaccacgcgtatcgaagccgcgcttcagcaccgccggggctgcttccacgtgttcccgatgccgaacgtcaacggcgtgtactacgggcgcgatgtcggctacaaggtcgagcagattcgcctcactgaagaaatcgagtcgatcagcgcgaccgcgatccgcaagcgaggcggcgtatgaagtacgtcatcctgaaggccacgttcgccgacatggacgtgagcaaggcgttccccttcatcttctccgagcacctgacccactcggaaatcgccaaggcgatgaagcggcacgtcaccatcgagcttcgaccggccaacgtcgaggtcgaagtccacagcgccgggttctgcaacgtcactaaggacggcttcgtgtgcgtgcggggcagcgaaacgctgaacatcaagaaggaagagacgcgctgtgccgatgacgagcgcacgatcaccttcaacgattccatgagcatcatgctgtaacaaccggagccgagtgccatgcgcgagatgtatcaggaaatcacgttcaagaagaagagcctcgaaatgatcgaccgcatcaacggcatcattgaggtctatcaggacgaaggctacacgctgacagtgcgccagctttactaccagctcgttgcccgcgacatcattccgaacaacgagaagtcctataagtacatcacccgcctcgtcaacgatggccgcatcgccggtctggttgattgggacgccatcgaagaccgcacgcgttcgttcgaggcgcgcgggcgttggaataacccgaaggacatcctgacggccagcgccaagcagtaccacaccgacccgtgggccgcgcaggaccgccgcattttccttgtagtcgagaaggaagcactggtcggcgtgttccaaaacgtgtgctggaattacgatgtgccgctgctcgcggcgcgcggctacccgagcgcatcggttgtgcgtgatttcgcgcggcgggaaatcgaacacaacgccgacaaggacgtgctgatcctgcacttcggcgaccacgacccgagcggcatcgacatgacgcgcgacctgatcgaacgcttccagttgttcggcctgggcggcgagttcgagttgaagcgcatggcgttgaactacgaccagatcgaagagttgaagccgccgccgaacccggcaaaaaccacggactcgcgtttcgtgaattaccgcaagcgatttggcgaatcgagctgggagctggacgctctgccgcccaccgtgctgagcaacatggcccgcgacgaaatcctgagccacatcgacgcggcggcttggaagacgtgggacgatggactgaaggagacgcgcgagaaaatgctgaagcacgtcgagaagttcaaggggtaagccatgatctacatcatcgccggagacgacagacaggccgaacagtgcgccgacatcaaaggcgcatcgcgcggcgagtggaagcgggtagcgagcctcaacgacatccggggccgccgctgggacggcatcacggtgtatgcgttcggtacgttccgcacgcggcacatgttcgagtggcgcgagatggtggaggcgctgcaacacctgggcggcaagttggaacaggtgatcgacggacgcttgacacgctgacccacgcggccttatggtcgagtcgtcgaagcgatattgcccttccagccggaccagcgcatagcgaaaaccggaatcagcagaaccacgcagtcgacacccggccaccgacgagagtcgcgccacccccggaaggccccgtctcagcaacggggcctttcttttgcggtcaagaccaaccggggcaagaccaacttggccttgaccgcaaaagaaaaccccgggtgtttagtccggggtttccagttgcaggctgagcgccgattctcttcctgcgttccctaccgaggtgccgatgcaacgcgaagtgcgaccagcggccctaaagctatccccgaccgccggggctgtcaactaccggcggatcgcccccgccttctcgtacccgtccaggcaacgctcctgcacggccgccagggcgcgttcccgcttcaccgctaccagcgtactggcaacccactcggcggcccgtgcggacagccgggcgaggccgttgggccgttcgggggtgggcggcacccactccacccactcgtcagccgccggtagggggtccaggggcgtcgaggcggcctgtcggcagtccacggtaggcggtgccgggcgaacggcctgcgtgcagccgcacagggccaccagggcggccgccagcaccagggcgcgggcggtcatggcacacccccgttcgcgtccttccagcgggccagcagctcggcctgcaccgccgggtcgaccgggtggacgcagctaccggggctgaccggcttggtgacgatccggtcgcggtagacggttcggatggtctcgacggtctcgaccttcgtctgtccggcctgctgctcgaccgccgcggcttccttgtccgcctgctgggccacgtcgcggcccttcgcctcggtcttgatgtactgcgtgttgccctcggccttgcatgcgtcacgccccttctgttcgtagtgcgaggcgaagccccaccagcagagcagaatcaccacggccaggatcaacccctggcccagcctcgtgttcaacaaccagctcatagaaccccctccggccacgcgggcaacgggatgttgttggcgacgagcaacgcacgcagctcgtggatgtagaccagtcgtttcgctgaaacgtcgtcggccgcctgcgccatcctttgcgcgtgggacgctgcttccgatgcgcgtgcggcagcggcttttgcagtgtcagcttcgatgctcgccatgttggccgcgcgcttggcttcgccgatttcgttgtacccggcggcggttttgttgaaaagctcaccgagttgttcttccagctcccggttccgcttctgcaaccgctcgatcaaatcagtcttggccgcgttctcggtgtcgtcgagaatctggcccgagcgctgcctcttgatgacccaaccgacgccgccggtcaccagcgttcctagcagtgccgccacccacttccaggcgttcgtttcatccaccgtcaattcccctgtcatgttgtcgaccgcagcttccagctcaacgtccatcacgctgtttccagatcgctacgagtcgcctcagtacggagcacgcagaaaacagccatgaccagggccaggatgtgcgtgccaaccaagccccgccagccctcgaaggcggcataggacaggcagatgataaaccaagtgaacagcgcgaacacgttggaggcccaagccagccacgtcaccggccgcgtggagagcacgcgccacagcatgagcgacccgctgagccatagcattgccgaccatgcgtagaccggcagcgtggcgaacagcgcccaccgggtcggggcgggcatgggccggaccagcaaactcgcgccgaagatgaggctttgcagggcgagaatgaaacgcaccttcagcgtcgtgccttgggtgatggcgtgccacaagtcggcaccgattcgcggtttgatttccatctcagtttcctccgaattttctatgggctgctgcaagtttcacgtcgtattggttcttgcggtactgcgagccgttgtactttctcgcgacggtggcccaatcgccgcgcttcaaagcattccacaactcggtgtcactctggatgaacgccaccatgaggtcgagctgcgcgccctcgctgcggaacatgcggttgatgaaatcctgcaacgatgccgctccgactttcttccagttgttgcccaggatttgcgggatgccccagctcgttgcgcgcagtgcggcgtcgcggtcgagcgccacggcctgttgcagtttgccgtgctggctggcgtagctgctgtagggaaccgcgccccacaccggattgctcaggtgcgggtggctcttgtcgaagcggccgcccgtgtactccgagaacttgtgcggctcgaacaggatcgtgacctgcccgtcgtcctgaaacccgccgcgtggcgcttcgacatcgagaatggcgcgcaccttcgcctgggatacaacaagggccttggctgcgcgtgcgatgtcagcgtcggtgagcttcttcgagtcggtcatggtgcttctcctgattaattaagggccgggttcggacgtgaggcgatcccacagtaccgagttctgcatgatgccgccgtccgagtcgaaggcgattccgtagtacgcctggacgccgggcatgaggttgttgaactgcacgtagccgttcgcatccgagagctggatgtcgatcagcgtatgcaggcggcggtagaacaaagcgacgcgcacgttctgcaacggcgtgtcttcttgcgtatccgggtctcgctgcatcacgcggccgcgcagcttgtacgtcggcagcacgttggtcgaccccggagcgccccaccatggcgggacacctcgcgtcgacttggtggtctgcaccttccgcaaactggccggaggcgcgcgatagacctcgatcttcttgaccgaatcaaccttggttactttgtcccagccgatgcggctgcggcgaatgaacgcggcgaggcgtgcgggtgcaggcggcgggtcgatgacgttgatgtagacgttgcgaatgccgcccctgaaaatatacgagaagcccaagtacaaacgaccgccgattgcaaacgtgctgaccgcgtagttgtagttgcgggcgtgaggcaccgacgcttccactgcgccgtccaccaaaacgctcagcacaccgtcccttcgacggaacagcacggtgtgccagttgccatcgttaaccgcgctcgtcgtaccgattaccggcgattcgttggggccttccgccgtccagatcaaacgcccctcggtgctgaaatacacctgccacgtgcttccgctgccggtcaggtagtctagaacggtggagagcgtactgctcgtagtctggatgtcgaaagcgatgtcgaaatctttcgtgccgagcaggaaatcgccgccgctgttcgtgtagatcagaccgtcgcctataaaacgcgccgctccgtcgatgatgatcggagcgacgctgtagccgctccaaaatcgacctgtagcgtctgcgtacgaagtcgatccttccggcgagcttaggggtaggttggcgagcagcatttcagtttaccgatcccaggtgtcggagatttcaaacaacgcggagttctggtagtgcacccgatggaggaactgtttccctgccagttcgccctggccttcgaccaacgcgccatcgggcaggattccgaagtagtggcagtgaacccaaatgccgggcatgatcccgcgaatactgtagggtccgacattcgggttgtgcgcccacaccggagagaggtacagcccgccgtcagggccgtgaggatagctgaggttaccgttgccccaactgctgttgcccttggtcatatcgttgtgccagccgagcgtgatcgggccgcccaggttggtgaagtcacgcgcaaccgaaaggcggtagcggttcatcgccgaagaaatgctgtaaccctggaacggatactgctccgaagagttggggctgtcgggcgagtcgttctgcaacaggatggtgtgcgtggtgtcgcccggcttgaacgggatgatgtcgccgaacgcgtagcactcgcggtaatactgcgtgccgctctccgggtaagtggtcagcaacaaccagaagaacatctcgtctgcgataatcgtccacgggcgggggttcgccaccgagccgctactgtagtgggtgaaccaattgccgccctgcgggttctgcgcgagagtcgggaagggcgacggcgagccggtgttgacatcggtcatgacctcgtagccgacgaccttcgccttacggtagctggtggcggtgctggtgtcgtccacgcgcaggtacatgccattggagccagggccttgcttgaatgcggccacgttggtgccagcgaacggcttcgtccagcccgcgcccgccttgctgccgtagccggtgacgaggcacttttcgagcacgttgatgaggtcgccgggcgtattgccgcgaaggaccggagcgtctgcgtcagaagaggaataaactcgaacagtcatttcagaacctcacatagtcaagagaagcatgtaggaagacttgcgcaactcgttgccacctccgtcatcgtcagcaccgaaaatccactcgatgttgggcgacagcggcgggttgtactcgttgcccttgaacacccaaacgatgttgggcgatagcggcggggtgtattcgtcggccatcgtcagattccatccaccacggcctgcacatcgtagaagccgtcgtcatcgtcgtacacgaaaccgatgcggtcagactttcccggcgtggaagtggcgttgtaggtcgagatgaggttgttgaatcgaacattgttgctgaaggtaaccgcacggccgccaacagcgtcttgcttcagcaacagaacgcaaccctggccgtccagagcaccttccatgttgatctgcgtgttggccgtgagcgtcactcggatttcgtcgtacgagttccagtcgcagatgaccgagccgctggtggtgtcagtgattctctggatgcgacgctgcgatgggatgccgggcggcccctggataccggggtcacccttcgcgcctttcaacgacgccagccactcagcttgcgtaccggcgaatccgttcgccaccgccacctgatacgcgctcaggccgttcgcgccggttgcgcctgcgttgccttgcgggccgcgcagggattcgagcgacacgaggttgatccagttctcgtcaccgacgtagcgccagcggatgtagccgccgcccgtaccgatttcgatcagccgcccctcgaagaaaccgatgctgttccagggcgtcacgccgtcgccgatcttgaacttggtctcgtccgaagtcgcaccgagctgcacgccgatttccccggccgcgaggaccgggttcttcgattgccagttcgccgctacgtcgcggcgctgccacatgcgttgggcaacaactacctgggccattacgcgccgcctccgtcaagaacgtactccggctcgtcgaccgcgatggtgttcgtgatcgtgccgctggccggagtgtagctgaagtaggccacctgcttcgaccacgaggccaggccctcccgcatcgactcgatttcgatgcgcatgtctcctgctactgcgaggcggatggtcgcggcggtagcagcgtcggagaccgcaagcgcttctgccagtagggcgttcgagccggtgtagacccggatgttgtaggtcgtcccttcctccggcgtacgtgacggatcggcctgggaggcgatagtcccgtccaggcggttgcggtgcgcccaggtcaagatcatgtccccggtgaaggccgatccagcaccgaccggcgcggcgttgacccggattcggcccggcggcagcggccgcagagagcgcgagttggtcgtgaccgtgacggctgctgcgaggttgatgtcgagcgacgacgacacgttcttcggagctagcttcgtgttgaccgtgacgttgcccgagtagccgtcgacgttggtcgtgcccgcaccttcggacaggaagaacacgcgtgcgccggtagcgtgatcctgcgggatggtgtcgagcacagcgcggtacaccccggtgatcgtgaacgtgccgttgccgttgtcgacgatgttcttccatgccatgagttcgttgccgaccagcagcaggttctcgcctgcctctcgcgaaccatcggtgcctgggtcaagaccggtcagcccgatggccgacgacacggtgaagcctgcggtgtcgacttccgggccagtgcgcgacagaccggccaagagaacagcagacggcgtgtagccctcgaccacgttggtgatctggtaattcgacgcgccgctggggtcgctccacacgtcgtagccgatgacgccgttgctcgcgggcacgcccatcgtgatgagaaagcgtcggctcatatcgtcagcgccgaatgccggggcttcgatcacgcgctgcgcagcgaacggtgcgagagcagtaaccggcggaacccaatcacccggacccggcggcacgtacgctacagcgttgacctcgaagatgtcctccatcgcggtgatcttgatcgccgggtcgtccagggtgccgtagctgatttcgatcacgcgcatgagcacgttcgccagtccgcgatccggcttgcgcagccagaagccggagccgggacgcagcttgtagccgatgcggttgagcgacatcttcgccgagaccagcggcgacgctttcattttcgacacgcgagcagcggtgttcatcgccgcagtgtcattgctgaagccgaggtagctgaaggtctccgcgtcgatcatgccgccgcgcacgtcgatgttggcgaggtcttggtactgcaccggcttggtctcgaacgaggcgcggtcggtgtactcaacgatgatcgtattcttcgtcatctcccaggacgtgcgcgagaagtcgaagctgtcttcgaggatattgctgtcgtcaataaccagcaggtcgtccttctcggcctgcgagaactcacgggccagcgtcatcgtgtacaggccggtgaccggatcggcgtacaccacggcgtcagcgtggcgcagcacttcggccaggaggtctttgccgagcatggccgactgcaccagcatcgaaatgcccagcgactcttcagccagcaggttgccgcaagcgcggaacgagtcaacgtcgatcttgtcttcagggattttcatgccccacatgttgttggtcatcaactcatacgacgcgcacgcgatattcgcgtcgccgttgacgttgtggcggccgccggtcaggccgagctggttcgggcagcggcgagcaatgatcgagatgggcggcggcgtgtcgctgttgccgaggtagcacttctccatgaccatatgcaccaacgggcggaacgcggacatgtccggttcgttccactggccggagaggtagttgttcgtgccctgcgtgaacgtgccttggtacagaacgcacttgccaactacgccgctcggcgggtcgccgttgtcgagaatggacggcgagcagatgtagaactcgcacttgtcgccgacgaactccttgctcgcgacctgaccggccagccacgtgtccttgtacttgaacaccgagcgcacaaggtcagccaccttgtcgtctacgcgcagttcgatgaactcgtctgccgggccgtagccgaacacgagctgcacgcccaggtagtagttgtacccggtgacgatcttcttcgacgagaaccagccggtcttgaccttcttcttcagcgtcacgacttcgaggtcgccgaaccacaccacattcggccccatcatcttgcaggtgccccaccacaccggtacgacgcgcgaggcgtccacggtggggaacttgaagtcgcccacggccgatgggttcgggtcgttgaacttctgcttcggccgcagcagctcgccgacgattgcgacgacgattgcgacgataattgcgatccaggccattaggtgatcccctgctggaagacgttgtaggtcgggaagtgatcgaacccgacgtagttgatcttgttattgaacttgcccgagcagacttccttcgtgcgtgcgcagcctgcgtacacgtcgagaatctgcccgccctgcaccgtttggaacggatacacgaccttgatcgtggcggtggctgcgtcatgcgccgtgatgaaacgctgctcgccggtctcgcggtcgacgatgaagccgttggtgtagtagccggtcggcttggacgcgaactcaggcgagccgagcgtgtagccgtccacggtggtgatgagcgcatcacgccgccacagcgacttgtcgacgccgcaaccgatctggtacagcgcccacacgcaaccgaccttgaacaccacccacggcaccgtctgcgaaaggttgtcgatgatctgcgagcattgcagcgtcgcgtcagctcccttctggctgaagctcgtcacgaagccggtgaacgcctgcacgatttccgcgccggggtcattgcgctggtacgcgtagatcgtcagcttgatagggcgaggcggcagatacggcacgtgcgcggccgccacggggttgtcgaacggcacgacgacttccaggctctcgacgttggcatcgcctgcggtctgcttcagctcgccgcgtttaatcgcttcgggcctgtaagtaatcgggccaatcgagcgctcccgcgcatcggtggtgtacgcccagcggtaacggccgtcgtcgctctcaaacaggtaaagctccacgcgagagccttgttctttgctgctttcgtattgggccagagacatatcagtcctcggtcatcttggcgaccagcatcgactcgacggtggccttggaatcggtcaggtagcgcaccgtggtggaaggagactggaagcggtacagcgtcaaaaaactgatccgacgaatatcctgcggccgcacctcttcgccgagcgcactgtcgagctgcaaccgggtcaggttgtcgaactcgctaaccagcgtaatgcgacgacagaaataccgaccattcttcaacaggatgaagatgtcgcggcgagcaggatgcgcaccgaccagcttcgcgtattcgttcgactccaccacgagcgagttctcggtgtcgaggatcgtcgccgccatcgtgaaatcttcggtgccgctcggcatgtagaccgaacgagcaacaccctggcgacggccgaggaaacgacggaactcgaaaatgtcagcgcggtcgaacagcgtccagttatggcggcggctgattttcgagaagcccgaggtggtgaaggcaacgaacttgcctgtgccggtgtctacgcgcttcgtgtccgcgctgaaggagaaaggcatcgccgacagccagttggtctccttgatgtacagctcgtgccctcggtaggtcatcgggtccgggttcatcgccgcgttgcccggcgttacgctcggctcgaagtcgaacgacatcgccatgcggccaacgcgggaagtctcgcgctgctcggacatctcttcgctcatgaggccaacgaaacacggatacacgcgcgagtcggcaggccagtcgtactccaacccggtcgtgaccgaaacgccgtcagcagtgacctgctgcacttcgcggatttcgttcacctcgtcgtcgagatacagcgccaccagcgaaccgggttcgagcgacaggccgaaggtgttgaaggggataacgagcgagcccgcttcgacggctgcgtcggtacgcgactcttcgccccaatgcgggacgccgaagaagcgggcctgccatgcgaacagcagattctcggcgcgctgggcctgcttagaagtccgcagattgatgttgaactccaacgtgcgtcgcggcacttcacccgactcgctaccggtctgctcgctaccgtcgtccgacgacagcacccacgagcgatgcgtgatcgtctcgtcgaccggagacccccaattcggagagaacgggaagagaacgatgcggcggccggtgatcggcacggtgtagttgacgccttccacggtgaagcgcgcatagctgctgatcgtcggcgggcctgccagttcgatctgaacggtgaaatccagctcacgcagcggcggcatctcgaacggaatgctgacgcccgccgggggagacatcgaaatgcctgcctgcgggccgagcacggccgactccaacgtctgcggcgtgacgtaggcattccaaaggatgatgtgccggacctgcgtggacagcagattgcccgcatccagggcggccgggacgatgaagatgcggttgtagtagtcgtcgaagaagctcgtcatcttgcgctgcgccgacacaccccggtggttgctcgaatgcacgtgccagctaccgtagcggccctgcaagaagcgaccgccgtcgtagctgtcgaacatcgacacgacttcagtcagtttgttgaggtcatcactgagcatcgggttgtcgatgccccgctcaaacgcgctccccatttgtccgatacgtgctgccatgtcacggccccgtgtagcgaatggcgtaggcaaacgtgccgctgtgatccgcgccggtcgaccacggcacgccgttgcgcactgctgcgttcttacggtggaacgggtacaccttccagcggtcggtgccgtaggtcacgatttcgccggacaggtggttgtcgttgcgacacaggcgcgcgttttgcaggtctgcggcgatagtctgccccttcgagagacgacgctgcaccgcgagcaacggcaggagcacggtgctctggttgaactgcgacggcagcgattgcagcagagcggcaactggatcgccgctgcccatcaaatcaccttcgctggtccctacgcgcttccacccggttgagtccaggccagtgtggatgtaggagcagcccaggggcgcgttgtatacctcgtggaacaagccacaccccatgccgctccacccgaagccgacgtagctatccgacgcgttggtgtacacgagatgggttgccgcctgcaccacgtcactgcggaacgaaccggtgagccacatgccggtgccgccgacctgatcgacgcgagacttgccgaacgacaactgctggtacttgtcgccgttgtaattgatgacgaggtagacctcatcggtttcctcgaacacgtgcaggtcataggtcgccgggaagttcatcggcgagccgctgaagttcatgattttcacgccgtacggagccgcgcccggcagagggaacgggtcgacggcgctgccggtgcctgcgaacgctgcgatctggtagatgtcggtcgccacgaggcggacgtacatgccgttcttttccagcgtgccgtcgccgttgagcgcccagccgtggttctgaagcgccgcttccatcgacgccttcagcgtcacgaacgaagaaaaattgccggtgtagaacattaggtcatctccaagccgatgaagctgcgccagtcggttcgacccacgtcttgcagcatcacgaatgcgcggccgcccgccgcaaggactgcatcgacgtgctcagccacggtcatgccggtgctgtccaccgcagtgccgccgacctgcaccacgttctccacgttgttgttgaagccggaaatctggtacacgccgtccagctcgccgaagacatttcccgcgtaggtgtcgccgctggccgtggtggtgtacaggatgatcggctgcggctggtagttcgttcctgccgggaccagggagcggtggcttacgtccgtgtccaagtagctgtagttcgccaacgcgttgtagccgttccacgagttcgagccagccgcgccgttatagaacgggaaatgcgagaggcgacgccacgtgcctacctgatcgcgcagccacagcagcgaaggacgctccggggaagacgcgccgctctcacgaccgtgatacgggaacgcgtagtcgaggtccgagaatcgcttcgccgctgcgccgtcgaacatgcccgcgcacaccagcggcgaggggaactcgccggggcgggaatacgggaacatcttgcctgcatagaagtgcgtgtagaccggcgtgccgactttgaagcaaccggcgatgcgctgggcgttggcagtgatgaagtaggtgacggcgttgttatggcacggcacgccagaaagccgcgcgcccggctgagcgtcgaacgtgttagccgatacgaagccggtgaacacgcccacgaggatattgtagtagtcgccgctcgtgctgaagtaggtacggaagccgatgtagatgtcctccgttcccgacaagcccttcgagttcaaaatcagctcgcggttcgtgcctgtgttgacgtagcgcagcgtcgtccatccgttcgcttcagccagggtcttgatcgcagcgagtaccttgtagtacgcctcgtcgccgctgccgcccgtaacagttccgattgcgtgtcccatgttggttcctttaattgcccaggagtttcttgaaggaggctcggtcagccttgatgacgttgaagatcgcctgacgaccagcgcgggtgttagcaccggccgcaaccacgctctcgctgtcgatggtgttgatgatagacaggtctaccggggccgggccgctgccgccagccatgccgccgttgaagcggtggcgcggatcgttttcggtcaagacctcttcgttcttcttcagcaccgccggtacttcgtcggccgcgaagcccgccacgccgcccgtgtggtagcgcaccgcgctctcgtagacgtagctcggcaccgcacgcttcttcgacgccgcgccgaccacaccgccgtcatgcttcacgtagctcatcgccgcgttgatgatcgcgccccagccgccgctcgcgctctccgaagcctgcttcagcgcgttgaagatggcctgctggataatcatctgcgcgagctgcacgagaatgtcggcgatggtgttgagcacgatgtcgccgaagctcttccatgcgtcgcccgcactctggatgcccttcaggtagtcggacatcaccgccgcgctctccatgaaggcgttcgtgaagccgttggtgaacacgtcgacgatcttccgcttagtcgccgacatctcgaccgacatcgccttgatctgcgcattgaggttttcgaggttcgcgcgagcagcctgggcctgtgggccatcgcccagcgtagccatgaactcgaccgccttcagtcgcagagcttcgagctgcggcagcagacgagcgttgacctcttccatctgcgcggacgcttcgcttgccgtcagcagaccggcttcctgcaaggtgttgatcgtgtcgatggacgtgctgcgctgctgcaacagggtgttgatgcgagcctcgtagaactcctgctcggccaactgcttctgctgcttttcgaggtccggcagtgcgtccaggccgcgctgcgcttccttcttcgcatcgggcacgtttagcttttccgcctcgcggatcatgcgctccaactctgccttgcgatcagcgatcttgttgtcgatcaccttcagccggtcttccagcgtatccgggcgcgcctgggcgatgtcgctgtcgatgtcgcgcagcttctcggccacgtcttcttccaggcgcacacggcgctcggccagggcggcgaggcgcttctcttcggcctccttcttcttgcgcgccgcttcggccgccttcgctgccttggtgtccgtgcccgcacgctttgccgctgcgtccgcctcggcctggatgcgcttgaactcggccgacagcgcatcgttctcggtcgcggccgccttcgacttcgcgatgccgaggtcacggctggccgatgcgaccagctcgcgcagcggggccgcacggcgttcgaggttggcgagctgcgcctccatcgccttgccctcggcctcgacctgccggatagcctcgaactgcttcgacggcagattggcgtcgccttcccgagtgctctgcgcagtgcgaatcgcgacctgattcttgcggatggtcgtgttctgcgcgatctgatcggcgaggttcttcttctgctcatcgtagatcgtgagcaagcgctgcgctgcctgcacgcgcttttccaactgctcggtgttgtcgcgcgacagaactgcgaggtttcgctcggacgccgcaaaaccacggttgagttccgtgacggtcttctgcacatcgagcttgtcgttgttcgacttcagctcgcccttcatctggaaatagatcgggatgatgacgcccgccgaagcgattgccagcagcgccgcgatggggccgccgatcagcgccagcagcgaagcgcctgcgcgaccggcagacgcggccgtgcccgcaccgagcgccgtgttgagcgcgaccgtggctgcacgggccttcaggatttccgtagcgagctgagtgaagacgatggcgatgcgcgctgcctggatcgccagcatgatcgcgatcagctccttgaagttccgcacgaggaaggcgacggtgttcgctacggtctcgatcaggccgtcgtactcggcgaatacgtcgatcagctccttgcccgcttcagcggccgcgacgaagaccttcgtcagattcgcagcgaacttcttaccgtcgtcgctcttcaggaacttcgtcagatcgacgaacaggctgcgcagcgcagtaccgaggccgccgtcgatgatttcacgcttcagatcgccccacgcgttcgacatgcggttaatgtcgccgagcaagctgttcgatgcggccttggcctgcggaccataaataccgcgcgcagtttgcgccgccagcagcacgaactccgccttaacctcgccgcccttttcgagcatcttattcagctcttgcgtcgacacgccgatagccttcgcgaacaaattgaacgcgccggtcatgcggtcgccgagctggccgcgaagctcttctgcctggatgtagcccttcgagaaaatctgctccaaggcgcggaacgcgccctcagtctcttcgccactcaggcgcaggaccgtcgccgcttccgtgaacgactcgaagatataacgcgttgcttccgccgacataccggcatcgcgcgcagcaaccgagaaccggctgtacgaatccgccaacgggccgaaggcgaggcccagctcgtcagccttcttgcgcagatagtcgtattccttcgccgccgcgttggcgtcgcccttgtttgcgatcatgagacgcgacattgcgcgctcgcgatccacggcggcgtcgacgctttggttcaccagattgatcgcgccgaacacgcccacgtaggcagacaccagcgagagcacctgaccacgggtacgctgatacagcgacagcgcggtgcgctgcccggtgttgagcgcgttgagctgcttgctggtcttcgcggtcgactgctccaactgcgtcatcgtctgcgcgacctgcttctggccgttcgcaacgcgagtggcgttctgagcgaggcgctgctcgatgccgttgaggttttccagggtgatgcctgcggccgccgcacgctgctgcacgcggttgaacgcttcggtctgtcgacccaggtctgcctgggcctgccgcagtgcggcctgtgcgcgttgcagcgacgccgccagctcgtcgttcgggcgatccgatcgctccacggcttcggcgtagcgcagcacttcctggcgcgcttcctcgaaccgctgctggctggcggtcaaggccgtgttctgccgcgcgaggtcatcggcgagaccgccttggcccttcagcgcggcggccgcttcccgcaggcggcggctctggtcggccagcttctcgatgccgtcagcggccttcagggcgtccggcgtcagggcctcgaactccttgtcgagctggtcgacggccttttcgagctggtcgagcgtagcgaccgcctgcttggccggttccagcaccgcctgtacgcccgctgctgccccgcccagggtcgacccgctacccacggcaggggcggcggtagcgcgggccgcctgcgcagcctgcgtgccggtggcgcggaagttcgccccggcggccgccgccttctccttctcgcgggccagggtgcggtagacgttggtggtcagctcgacgaagcgctgctccttccgggcctgctcttcgcggtccttcgcggcctgggcaacagcagcggccgaatcgcgggcggcctgcgcctgctgccgttcttcctgctgcgcgagttcctgctgctgccgcacttcgcggacagcggtgtcgtagcgctccatgttgtcggtcgactgccggtacagcgccagcgagttgttgaccgcactgttgagttcctgctgcgactggctgaagcgggtcgtgtcgacgcccatctccttcagcttcgcgcccgacgtttccaggcggcgctcgttattccgcagcgacgcgtccaggcgagtgacttcactgccagcggccttcaactgctgggtgaactccttcgtcggcttctcggtgttgtaatactgctgcgcgagcgtgttgaggttttcgcgagcacgcgcgagttcttcgcggaggctgcgcacctgctgctcttgctgagcgtagccttccagcttgcgcgagcggtcgttgagcgacttcatgatagcgagcaacttctgctgctcgcccttcagactctcgaacgaccgctcggcgagacggttcgcatcggctacttcgttttggttttcggcgactttgcccagctcgtcattgagctgagaaatggttttcgtactgaggttcttcgcacgtacgatcagttcaacttcgttctgagcggccatcgcctatagctccgagatttgttccttgaatgcctgcgcgcccttcttgctgagcgcggagccgattgcgctttgaatcaaaaccgcttcagttctaatgcggttgttgacacgctcgcgcgcgagttccgtttctacgatcaacacacccagcggatactcgcctgcgagagcgtgtccttcagcggtcaggaaggagactgctgctcggattccgagccaccaccctgcgaatcgctcgattcgagatttttgtttcgcaggtgcggcaccacgctttttgctccgcgaagtgccgcttggacgtttcccaggaactcgcggaatccggcctcgtccttgaaggtaagttcggcgatggcgcgcatgcacttgatctgcgtcggcgcgtcgagctgcatggcgaccatccacgcttccggctcgtgcgcggcgtacgcgataacgcgtgcgatgaagtccggcatctgcaccatgagcttctggccgatctgcatcatgtcgacttcagcgaggtcggtggctttcttgacaccggcaccttcaacgatgtcgaagatttcttccatgttgtctttctgcgcgatgatgattccggccacgtcgttggcgttgaggccgaacagcacgatgctctgctgctcgtcatccgcgcccaggtacgggacggtgatggtgcgaaggcgaagggacgaaagggacattggcttcctcggttgctggcaagaaaacaggccgccccctttcggagagcggcctgtcgaagttggtcttggccttcttggtcttgactaagttggccttgaccgcgtttgacgcgccccggttacgccacctggggacggccgtcgatgtagacggtagcgtagccgtccagcttcaggatgtcgaacgcgaagctgagctgctgccattcgtcgcccttcagggccagatcgccgtccgcgcggagctgcacgtagggccacaggtagtcgcggcgcgggccggtcgggttgtaggagacgaagcgcagcgcgccttccacggtggtgccgtcgccgaccacgacctgcgagcgggtcgaggcggccgcgctgtagttgatggtgaacgcctcggtgccgtcgatagcgccgcccgggaccacgtagagctggcccagctcggagtcgacggtgtagtcctcgttgagcgtgtacgggacgggggtgcccgcgccatcggtgacgctggtgatggtcacgttgcgcacgccggtcgggttcgccagcgactcgccgatctggatgtaggtgcccggcttgacgcggttggccggaaccacctggacctgcgcggtgagggccgcctgcgccacgacgctcacgtcgcccaggaaccacagggccacgttgtcatcgctgatttcgtcggcgatgaaggtgccgctgtcggtcttttccagaacgatgctcttgtccttcgtgcgaatgccccggtcactgttgaagtgatcgaggttttcgctctcggtggtgaggttcagttccggggtgttgcccaggtaacgctcgccggtcttgttgcgggtgcccggtacgaacttgtcgaaacgcagttcgccacggccaagggtgtaattctcgctgcccattgtggtctccttcgggtggtgttgcaggggttaatcacgaatccagtacgggtctcccaccttctcgacgagttccattcggaccctcatccagaagtacgctttgtcggattgctcgtcgggaggccgaacaaccccgggttcgatggacagcgtgtttgcgagaccaccgaagaacccgtcttggttgcgcggggtaatcaacttccccagcgccttttttacgtcgcccatgagcagatgtgccgcatccgtctcatcgtcgccctcggccagtcctgagttgtcagcccagccgttgagcaggtaaatctgatcgtacttgtgcttctgcccgacgaacccgccgatagtttccggcaagcggtcggggttgaagttttccagcaccgccacgcccggcagcttcatctccttgccgaagttgcgcttgtcacgacgaaccatcgcgaggtcgaagttgtagccgttcgccagggtgatttcgctcttcaggtaatcgcagagcgtcttgaccagcaacagtcgcttcgtatcagccacggttcaatctcccgaagttgcggaggaagctcgattcgagtgcgtcacccaccgggccttgcacatcgaaccgaacatcacgaaatacttgatcgacggacggaccatacaacaggtagaggcttccgctcacgttgaccgcctgcttcttgttcaagccgccgggcagctctccctgcttgttgagccgcaccgcaataccttcgttcgagttctcggcgtcgtacacgccgttgccgcgccgcagcttgatcggaaatgcgccggggatgcgcttcgatccgccggtcgcggaaaccttgactcgaacgtagccgcctttgccgagcttcgcgccctgctcgaactgagccagagaggtcggccggtgacgaccggagatgacgcctacgaggtcgcctacgcgggccttcttcgctacacgcagtctcgcgcccggatcggtcgcgttgccgatgtagctcgccttgaacgcaacctgctcgcgaatgcgacggctgctctcggcctgaccgaacgtgatcgcttcgttgatcgcaacagccgatgcgcggtcgaccgtttccggtatgccgctcaccatcttgcgcacgtcgtcgagtccgttgatggtcaggccgatggtcatggagcggtctccgttactgcccacttgacgtagcgactgtcctcggaaggatgctccacgtcgagtttgaaagtcctgttgagctgcgggaaattaatccggttgccctcttctgcgacgatgccgtttgccagcagctcgcgagtgtcgatcacaacgtagtccacatcgtcgacggtcgtcgcgaagccttcgcggtcgaggtcgccgtacgtgcgcaccttgtagtgcaaacgagcggacgtgtccgtagacacgccgcccgccgaacggaacagggctgggataccgaacgtcttgtgcgtcacatcacgcgcgcgttgtttgatttcaagccagcccatgttccgtctcctagcgcccaggcgcgattactgctgcttcttgccgtcgttcttgtcggtcgtctcgaccttcggcggggcggagccagagctggccggagcctcgtcttcttccttcgccgcgtccttcgccgacttggcgtagccgttgtcgacgagctgcttctgcaacttggcgtcttcggtggtgaactcctggcccgcctggatttcctgcatcgcggtgcccaggccatccagggcatcgaagtcgcccttcagcgccacgcgagcgaccagcttcttgccagcggccgcagccttggtggtcttcttgtcgtcagccatttctacatctcctgttgcggggttgattgggtggtgtaaacagcgcggcccggcgaaccgggcgttgctggtgaaacggccttacgcgacgacgcgtgcgcgcagggtgcagttcggacggctcgggatcatgagcggcgcggactgcgacagcaggtagatcacggacgggtccgggttcttccacatcttcgggaagatgtcgagcgcctgcaaaccggcgtcggcatccatgatcgcgccgaaggcacgcacgccgtcgaagccaccttcagcttccagcagcacgtcgcgcgggtccatcatcggctgcatggtgccggtctcgtcttcgtacacatcgctgtacacgtagatgttgaacgcgccgatctggcccttgtactccacgctctcgcccaggcccgggccggtctcggcttccgacttcgagccgcgacgggtttccagcagctccttgatggccgggtgcttgcggaacgccttccaggcggtgctgcccatcgtgacgcgagtgaccacgaagccttcagcttcacggatacgcgcggcccaatcttccaggtcgtcgtccgggttgctgttgtcgtagtcgctccacgcggcggtgcccgacaggatgacggtgtggttggcggcacgaccgaagtcgatggtcacgctcgggtagtcttcgcccgacacggtgacctgaccgtacagcgcggcctgcgcgcccatccactcgaagcggcggtaaatctggttgcgctgatcgagctggtacgcggccacagtggcctgccagcgctggcccggggtcatgtcgccggtcagaccttcaccggccaagcgacgcagcatgcggcccggggtgaccgcatccttcggcttgacgtaggccggacggaaggtcttggtgtagaagccggaacgcttcaggacgcgaccctgcaagttcggagccacgaacggagccatgcgacggccgagacgcagctcgtcgaacatgatttcttcggtcgtgaagttgatctgctccttgtacagacggtcgaggaaatactgcacgggcggccggctgtcgacgatcaccttgcgcagttccgcagtgctatacaaatccatcgtgcttctcctgtttcagttgagttatgtgcgaaacgtattgcgggtgaatcgccggttagaccgggccggagttcggggcggggttgccgtacaggcgctgcgccacgatgttcgtgccgtcgaagaccgcgatcttcttctgcacggtgttggaggcagcgttgaaggtcagggcatcgacgttgaacacgccgcccgagtacgcaccttcccacttgccagcggtcggcgtcggaacgtcgtagccgaggatgtgggttgcgttctgcgaaccatcggtcgccgccggatcgtgcttggcgaacaggccggaggcggtgacgcggccgagcacctgaccgccgacgtaggcgacgccggtcacgagctgcacctgggtggtaacgatgtcggactcaccagcgaagagctggatgttgccattggcgttgctgttgtcgaccgagacgccagcgatggggccaaagttggtcattgcgatgtactcctgtgagtggactaggtagccggtttttcccgtctaggctggcgacggtgttctttacttgacggccttcagcacgctcttgttgccggtggcgtgggcgtaggcaccgagcagaccgccatcggccttctcgcccttgtcgccttcgtcttcgccgtcgccgccgttattggagatgtcagcgccgccgccggtcttttccatcgccgcgtcgagcgcggacttgccggtggaggccgacgccttcggcgacgcagcgagtgcggccttggcttcgtcgacgctcatgctgctcttgaaggcgaagtggttggcgagaccttcgcggcccttcgcttcttcgcaggtggtgatgccttcgatacgagcgcgctcgttggcagcgtggtcgaccttctcttcggtcttcttctgctgctcgacggtggcgtcggtcttcttctgctcttcgacggtggcgtcgggcttcttggtatcgctcatggtgggactcctgttttcgctggtggaagagccgaagacttcggcccggaaggaagcgactgcctcttgcggagacatgaccgcatcgaccaagccgaccttgaccgcatcgtccgcgccatagacgcgggcctgcgtgtcacgaatcgcttgttcggacattccgcgattagctgcaaccacggaaatgaacttctgccacatcccgtccaggcgcacctgcatgtcggcgcgcacgttgtcgggaagcggactataggggtttccgtcgaccttgtgttcgccggagtggatcagcgaaatggcgacgccgaacttctccatcgccttgctcagatcgacgtgcatggtgacgacgccgatgctgccggaatcgccggagggggtcgacaccatcttcttcgccgagctgcccagcgaatacgcgccagacatcgcgcccgcgttgacgaccgacagggtgggcttctcggcgcgcttgctgcggatgtgatcggccagctcgaagttgccgtagaccatgccgccgccggaatggatgtcgaatacgatgcccgccacgtccgggtcggccatcgcagcgtcgaactcgcgacgaatgtcgtcgtagccgcgcgtgccgtaccacgagtcgccgttacgatgcacgagcgtgccgcgcatcgggatgaaggcgaggccgtcgctgaaggcaaacgccttggaacgctcgcgcgggaacgagatgtcgaaggcacgctccatgagcaccacctgggcctcttcagccgccgcgcgctgttcggcggtcggcggggcctgctgaagcatcatcgacgagaacatcgtcgcgatattctccatctcctgcggtgcgatcagggccgggcggccgttgaagccctccatgatcgacatgcgcatcgccagcaattcattcatcgtcgttctccgtttcggtttcggtagccgtgtccgccttggcgtcatcgttcgcggcgctgtcagtagccttctgcgtgcccggcttgctggtcgacatcgtgaagttgagcttcttctgctcgatgaggcgctgctcgcgcatgtgctgctcgaacacttcgcgatagtccttgcccagcttgcccagctcgtcttcgtacgtcgacaggcccgatgcgatgcgcagcacggcggcctgggtttccttcagctcgtcgatctggccgcgcgatgcgccgatccagtcgcacttgatgtacgcctcgcgattgatgccctcgtagaaatgcgcggcacccttcggcatcggcagatcggtctccgggcggttgatttcctcttccagccacagcatgtagatcatcgtcgcgaagcggtcggtgatgagcttcttgcgcgactgcatgaacttccacgtctcgatcatagacgcacgagccgacgagtagttcgtcttcgagtagtccttcgagaactgctcgtagctcaggcccagcgccgcgcagatgtgccgcagcagcgagtcctcgaagtcactgccgacgccgcccggctgaccggcgttttgcaggttgagcttcgtgcccgggaacaaatgcgggatacgcacgccgtcgatagcgaggttgtcggaagaacccacgtactcggccagcgcgcccatgtacttctgcaaccacgtcatgtcgccggagccgagctgcgcgaacaccatctcgcgcggcagctccgactcgatagccgcagcaaaggtcgcattgaccaccgcgttttgcagaacgatgtccttgtagaccttcgtcatgcgcatttctttcagcaccgccaccatctgcgaaacaccacgcgtctgaccggggcgcaggatgtcggcgatgtggatgacctgcgggcggccccacggcttgaacgccggaacgcgcgtccacttcgcgccgaatcggtcgtagtaggattccatcgggtgagcgtcgcggatgtggtacgcctgggctgcaccgaaacgatcaatctccacgccacggcgcaggaacgcagtgtcgctattgtcgttcggattcgacaggcgatccgggtcgatcatgttgatggcggtcttgtacggacggccgttgcccttcaggtactccgaagtcgccagcgtctcgcccgccatgaacgcctgggccagcgccatgcgcacgagacccgtcaggccgttcttgcgcgaggcgtcaatccagttcatcggcgactcggcgtacagcatgaacttgcgctcggcgatgagctggaactcttcggcccacttttcgtcgaagccgagcgagcgccagtcgggccgagcgttcaaaaggtactggccgccgacgatggagtccttgctcgtgtcgagcgcgccctggatgtagccgtcgttgcgaatcagatcgcgggtgcgcgcatccatgcgcactttgtccggcgtgatttccatgtccggcggcagcgagggcgcggaccacaacgcggtctgtcggttgaggttcttcgcgccctcgaaggcaccgccgaaaatcatgtcgttcatcgtgcgctggaaggcggcatcgccctccggagaacgtactactgcgaggtcttggctcatggtctaggccgccttaaaagagagggcgaagggggccgccgattactgcgacccccagcatggcgttgatctgagcctggagcatggcgatgtacttcagcagggatgccgggttggcccggctgtactcaacccgctccccgttctggtcgaccacgaccgtcaccgcgccgcccatcatggcggtgtgataggccgcttgtgcctccgcaagcatggcttgcaactgttcgagggtcattgtgcgtcatcccagggtggctccgaattgaccgaaaccataatccgtagtcgggcttgacgcaaacctcttttcctgatcggcaggtcgcacaagagagttgttactccactcgtcgtaccagctctccgggttgtcccaatcgaaatgctcgaccttcagaatggtgcagaggccgaggcagtagtacgccaaatcccatgcttcgttgcgtcgcttgcctgggttcaaccaacggttcttgtcgtcgcggaactccaccgtcatctcgacgtacacatagtccggcgtccacttgttgaagaagtagcgagcaccgccgtccttcttcgcgtcgagcatgccgagcaacgtgtccttcagcacgttcgagttcaagaacagcaccggcacctcgccgcgcgcaccggccgagcgatcctttcgatccgagtcggggtagtcaatctcggcgcgcggggcaccgaacttcggctcgcccttgatgagcagcactcggttgcccttggcgctatcacgcattgaccgccagtagttgtaggcgcgcgtcgtggagcctgacttaccgccggagtcgatgcctgtcatcttgatcgacatgaagccgctgccgtcttccagctcgtactccttctcgacgacctgctctgtaatcaagtcccaatcttcctgcaccgcgtacggcttgacccacaacgtatcgcctgcgtcgtccttgcgcttcgacttctggatgttgaagcggtccaccatgtacacgtcgtagcccgcgccgctctcgctcgggccgatgccgtgtacggtcacgacgaacatgttcttctgaacgtcgacggtggcgagcaggaagcgagcgccgtacggcaccttcttctcggcccacttgatcgcgttcgattgcaggtcttccggcaggcggttcgagtcggtagcgttgaacggccagaacggttcgccctggtcggtgttgatcgtggccttcagcgccttcgtttcagcggtcagctcgaacgtctgctgggcctgcaacatacgctcgacgagcttctgccacgtgatgaagcgcgcggccggtcccttcagccagaacgacgcagtgcgcgaacgcgcgccgacgccctgcttgttgccgtcgcggtcgagactctgcccatcgcgaagccacacgccgcgtcggttcatctcgtacttgtgcttcggctcgatcacgcagccgttcttcgggcacgccatgacggtcgactcggaagccgcaaacggatcggggttcttcgtgtcccagcgcagcagcgagaacttcggctcgaaccactcgccgcagtgcgggcactgccagtagaagcagcggcggtcgccttcgttgtacaggccgccaatgccgtcagtcggcgggaacatgtgcgagtccgggcgcggcggcttccacttcgggtctttcacgtcgaacgacggcgacgactcggccagcgtcatgccgaacgagccgaacgtcgtggtgcgcttacgggccagcgggaacggcgggccgttcttctcgatgtcctgcggcatgcggtcgtagtcggtgagcgcaacacgcggcaccggcttgcccgagagctggttgatcgtcggccagcccagcgtgagcatcatgccgttgcggtagaacttgtcgaagatgttgtcgttgtcattgccgggacgcagcagtgcgccaatctcgcggctgtcgcggtgcatcttgtcgatacggcggtacgagaaatctcgcgccgtgtcgcgcgcggtctggatcaagaagaagtcggccgggtcgcagcgcgccgtgtacgcgatccagttcaagatgatttcggtcttgccgccctgcgcagggccgatgaagatgcacgactcaaaatcgcggctgttgagcacgtccatcggctcgacaaggtacggcgtctcttcattgagccaggggccgacgtacgatccttcgttgtcgaggtagcggtacttcgacgctgcctgcgatacggtcaaacgctcgggcgggagcagcaccgagttcgcagcgtaggtcagcagttcgcccaggtcgttgaaggtgctctgcgcgccctgggaaagctgtgcagacgaaaacaggtcatccatatcactcatcctcgtccagtccgatgtcgtcgaccttgatgtcggcgagctgctccttgtccttgaagcctgcgtacatctcgaagtcttccacaaggcgctggcgcagcgtcgtcaacgcgacatcggagatttcgcgctcgatgatcttgcgctgttccggcgtcaggtcggtgcgtgcctcaacgcgatccgccagcaggcgcaacgtctgcgacagcgagcggaaagcgccgacgaaaatctccatgacctgctgcgtgcgccacaggtcaccggcgttctccttgtacttcaacttgctgttctgcgcgttccaatactgcgcctgcaacgcggacggcaaatcgccagggccgacttccgcaaggtacttggcgatgtcgacgataggctccacgaggtacggcgcggcggccgacacgtggtaggtgggcgcgccacggcggtcgccggtcggacgcagcgggcgcaacttctcggtgacggtgcggcggtccaggcggaacaactgcgcgaggcgcgggatcgtcatgccgttgaagaactcttcttcgtagtcgattttagctgcggacatttttcagttctctctgtacgtcggcgacacgtcgccgcatgggttctttcagggcgtcttgcgttacttctttgcgcaccagctcgcgggtcaggtcttcttcaatcgtgcctatcgcggtcaggtgcatcatgttcacgtgtgaggcttgctggcctcggcggtgcaggcgctttcgcaactgcatgtacagctccaaatccggcgtgtggtcgtaccagatcaggttgttgccgccgcgctgaaggttgacgccgtgaccgatgctcgccggatgcacttctgcgatttcgatgtcacgcgcattccaggcgtcgatgtctttcttcgtcttcagcgagcggatgttcgggaacgcgtctttcagccggagccgcgagtgctgccacgtgcgcgccacgagaatcggcgagccgtcgctaaactcgacgatttccttcatgcgctcgatcttgcggtcatgcacgtcgatgaaggtcttctcatcatctccggtgtagacccggccgcatgcgaactgaagcagcttgccgtacaacgcgccttccgagagcgcgcggacgttcgggtcttcttcctctccccacttcagcaccgacgtgcgctcgaactcccgatactgctccaagaccttcttaggcaggatgatcggcaccgggcgaggaatgagcggcggcagcttgacgtaatcctcttcccgcagcgtgtacacgatgtcggcgacgcgcttggtgatcgacttcagcgcgaacggcttcggcgtgatcttgcgccccatgaactccttgttgaagaagtgcgcgaggaacttgctgtaggacgcgaacaaacgctcgccgccgtccatgatcgccatctgcgcccacacttgatgcaggccgttcggactaggcgtgccggtgagctggatcacgtcagtctcggggcggtgcgcgagctttaccgcgtgcttccagcgcttcgacgccttattgcggaacatgctcgattcgtcgaacacaatcgcgtcccacggcaccggcttcttgttgttcttgaacagcgacgcgagacgatccagcttatgcaccgagatgccgtcaatctcgcacggccgctccaactgcatgcgcatgtgctcaggcgtgccgtcgagttcctgaaagtcgagccagtgcgtgtgctcccagctatcgacctccgtaggccacgtgtcggacaccaccagcggcggcccgacgaccagcacgcggctccactcgccggagaacaccttgtcggacacgtgcgtgagcacgaccaccgtcttgcccaggcccatgtcgacccacaaagcacaactgccgacactctcgataaagaggccagcagcgcgttgatagtcgtccagtagcgagcgttcgagtcgttccttcatgcgaacacccactcggcgaactctttgtcgaagtagtcgatcaccagcacgaccatgcccttctttcgcagctccttgtgttcttcgatctggttcgccgtaggctttccgccggggcgcttgaactcgatgaagaacacgaagccgttgcggacgaacatgcggtcgggaacgctgctgttgccgggcgaagagaacttgtacgccttccacccggccttgcgcgccaccttgcaccacttctcttctacgtctttttcgagacggtgcttgtcggttgataggatgtcgcctctcatttctgatagcactccacggtttctgccttcgcgcggatcggcacttcgtcgccccaccactccggctgtacggtcatgtcgtcttcaaggtcgcgcgctgcaatctctgcgagcttcgccttgaccaagcctacgatttcatcgtgtacgtgcatgcggatgtccagcccgttgtcccaagcggtcacgatgccgatagccagcagctcgcgtgcaatcgcctgcaccaagttctcaacgatcttgccgccgtgcgagtcgatccgcatccagaccttgcggctcttcccgccgtagccctcgtagctgaagcccttcttcgacttgtacttcggcttgccggtcctcttgtcgatgccgaccttgatctttttccacgacatctgcggacgcaggtagtgcaggtagcggccggacggcaggcgcatgcgcaggaacggccccttcacgtccatgagaatcgggccgacgcgctgcggctccttcgtgcgcatcaccttctcgacagcacgttcgaggtcgtaccagagctgcacgatttcgtcgtactcgctgcggaagaacgctaccaccgcagccgcttcctccgccgtcatctcaatgcccatgctctctgcgtagcccagcaggccgg

SEQ ID NO: 19 - DNA, 43324 bp, Unknown
  Bacteriophage Xfas301
cgcaggctgaccttacgcataccagcgctctacgctgtgctcgtaggtcacgaactctttccactggcgtggctgcgcagccagttgcatcggcgaacgcttgccgttatgtcggcgcttgaagatgacggggatcatgcaatgtgccctccttgttgggcgtgattccaaagctgcgccctcgttggaaggcgcagcggtagatcacgtgcggttcgggtgccacttcacgcggtagcggtggcggtcagcgatgggaacgtgggtgttgatggcgaggcgtgcgccctcggcggacgggaacgtgtcgcgcagccagtggctttcgctgcggccccagccgagcgggcggttcaccttgcggaagtattccaccacgtagtagccacggtcacgctccgggccgcccggcgtggtgctcggcacgacacggtagctgttcggattggtcccgtagcgcttgatcctcgcacgcatctggcgatacgcctcgttgcgggaggtgtacgtcgagttggcgatctgcccattgccaacgcagctcacccagctattcccgtgttcgaggtactgcacgatccacttcttcggctgggcttccggcgtcagggccacacggcgtgcagtctggtcgtccatcagcacgtcgggcagcggtcggcgcggcaggttgtccggcatcgggatgtccgagaggcgcatgcgcccggtcacggtgcgcggcggcggaatgggtgcgcccttcatcagactggcgagcaccagcacctccagcaggccgaggtcggcgtccagcatggatttgccgccactcgggcgggccatcggctgggtcagcagctcgccacggcgcacaccggccacgcctgccgggatcagctcgtggaagatcggcttgccgttgaaagtctccacctcggtgcggaaccgtgcgcccatcttgtgcggcagatcacgcagcaccgcatacagcggcgagctgccgccgacgtggctgaagcggaacgtgcccagcagctcggcctgttccttggtcagcaccagcacgtactggctgccgtcattggtcttcatggtagtcatgcgttcacgctctccttggtcagttcgtcgatcaggaaggtcagcaggcggcgacggctccggccatactcgctgtcctcgtcgtacatgttgccgttgtacagggcgcactcgtccaccgcgtcgaagtaggcggcagcggctgcatcgggatcgtcccagtccaccgtgtccatttcgttgtcggaacggtactcgtcgatcatgtcgtcatcttcgcccgacgccgggaccgggtacgtgctgcacccgctccactccggccactcccggtagagctgcgtgcggaggtccacggcagcgcccacctcgtcttgggtgtagtcgtcacgatagcggatgtcttgcatctggtcggcgagcttctcgcacagggcttcgccaagcgagttctcgtcgtcgatgtccgcacgggcggcgatggccgcagcgaggaggagcgcaacaacgcgctccccgtagattcccgtgaggcggctcatgccttcacctcggcgctcttgcgcttggcggcgggcttcggcaccttgtgcgcggcttcgatcacggcgcgctcctcctcggacggagtatagccgccctcgacggccttctccagacggcccagcagcttgtgcaggtccgcagcgaagctgaactcctcggcgggcttctcggtcttgaagtcgtgccacatcttggcggcggcgcgctccagcatggcggccagctcctcgccctccagccgcttgctcttggcgtacttcatcggcatggcggccttggtctccttgtcgtcgttcggagccatcgggccgaactcggacaggtacaggcgcagcgcctcgtgcttcatgccgttgcccacggcaaggcacaggtcggacgccagagtcacgtcgccgtggacgtgggcatggttgatgacggcgatggcggtctgctggatcgtgtccaccagcttggtgcgcgccgtattgatggccttgatgctcttgcggatgttggccgcattggtctcgatgttcatggtctggtccactcggttatcgtgccagtcgcacgcagatacgccctccgcaagggaaggcgcatcgtcatacgtcctgttacaggtaggctcggcgatccgccgcatgattcgcccttgccgtgccgctattcccagcgacaaacacagatcgctttccggcggttccgtggcgtgcctcgtagcgttctgcgtcgcgcttgcgctgggcgagcttgcggtcatactccgtcgtccgcaggtccatcacgcttgcagtccgggtgaactggcaaaagcggcgcttggtgcgggtgcgttcgaggttagcgttgccgtgcatagtggtgcctccattggcactgtgagaaagcgaaaacatacagattgaagcggcttctacaggccgggctgcaatccctcctgtaagccttgcagtagtcaacggaacaacgcctatcgtgggcgcacactggtgcggagctaccgctatccatcgaaccgtgaagccgcttcaatctgtatgccccttcgggttgtcaaccttactccgggcatacagtgccatagtcaccgtgtcccgtaggcttgcacgtatccctccagtgagggtgcccggaactgccccgagctatgaccggcttcctgtattccgacaggttgcttcccgtggccgactctcacggcagatgggaaaccctacccgttagcagtaggtatagcggcaccagtgttgcaagtctggtggattctatgggcctttgacatcccagttcatccggttatccgctagtgctacgttgcagcttggcggtccacctagagctatcccattagctccgtcgcaggcttcccgttacaccctacccgttagcggtagtcttagctgatccttcagccttggtgcctatggtagcgcaccgtttgcatcttgtcaagccctattgtctcgactgggcgtcctgtcgccaccatcctaccatgtaagccggtagtccgctagtagtcgctccgcctttaggcttcctgaccgttggtgcatagtagcttactcttggcttcctgtcaagcccggtagggtagctcctcgcataatcctaccagtagctaaggccgcttgcccttgtcgtctgcccgaaggcgtcccagcggcttgctcatagcttgttactcgactgaccactagcttaccactatgctaaccgtctgtcaaccctcttggctgtcaatgcttgccgtgtggcttgcatcggcgaccgcagggaggatgctagtctatagctaggctatctgtcaaccccttggttcacttccggctaaagaccgatacgattttcaggacatgccctctgtcgtatgtgtaccaaaaggaaaacgatacagatgccgccctcccgtccctcagtgcgtccgcatcatagcccggtagggttgcccctgtcaagccctgcgtgcgccctgtaggcccgctggtggccccgtggcctgcatccaatgtgcggcccgtgcttccaacgtggagccatcatcgcacacccattctgaaccgtagctgaacaaatccagccgccttgcgtgagctgctgtcctgcctcaccagtgcgccggtgtactacctgaccagcacacctccacgcgagaggagagaggaacacgcgcccgcgtaacgcccacgcacgcgcacgcacaggcacccacaggcgcacgcgcgcatacacccgcacgcacccacgcgcgtcacgcgggagggcgcatgggggcgcacacgcgagctttgattggagtggcccccgcgcaattctaaatcaaaatttggtccagctcccgatcagcccgtcttaagcctaacgatgggcgcagcggagtacatgtcgatagcgcacgcggcagccacggccttagccgcagacttgctcacatggtacgctccacgagcaatacccgcgccgctgccaatgaagatcggagcgtcatcaggccaagacttcttaccgctaacgactgtcgcctgtccgtccttgatgataagcacggtggagctaccactgaccagcggctcgatggcttctccgcctttgagggcggctacaacggagcggaggacgtgaatctcaccggctacggcgcagaagaccggaccctccggggtttggacccggagagccttggtcatcgtgcccttcatgtcgtccgcagtgacttggctgtcggcatacaggtgcttgccgtcccacacaatggtcgtcatgcctacttctccaccttgcagcgccaaccgcaggcttgcttgtagccgtcgtaccacgcacgcagggcgcgcttgtccacgttgcagagcttaacgtcgaactctcggtcgatagcgagcttcgctacgtcggagtttgacggattctccttggtgaggtacgttacggcgcaatcttcaaggtactgcgcgggcggagccggtatcgtgacgcaggaggtcagcgacatcagcaggaacaggctcgtcagcccactcaggactgcgggcaagggcttgatcgagcgcggcatgcgcgttctccttctcgattactacggttttgagttccttagccgcagtggtagcggccgaggcgttgcccgacgcctgctggtagtcctgctggacgttggctcgggagttgcggaggtgcagcgagtacgcggacaggaggattacggccgcaagcagcagccctccgatcagcaactcgattttacggaagatagacataaggtccgtccttcaggcacatggcctgctcctcgtaccgtcgggtcacaaggccgttcagtaccatcttgttggcgtaaatccaccggggatactggttgcagctcccacggcggtctccggcgttgaccttgcgaagcagggtcgatgcccggagattcggttcacccacgttgaagacgaaggacaccatcgcgtcgtactccccttgcttcaggggaacgcgcacgttgcgctggacagcccgctccgccacgcggaggtcttcggcataccactggtcgcactgctcgtgcgtggcccgcatgccgcgatacacgcccttggtatggccccggcagatggtccacggcgcgccgccagtggccgggtcagggtaggccaccagccggtagccttcatgggaagcgatctgctgcgccccgtcgagcgagaggtaggttgccccacctcccgccactgcgagggccagcagcgcggccatgacgcgcttgctgacgttcatggtcagccctccgggtccggctcgggttcggtcggcagcgcgccgccaccggggccggacgattccgcacgggactgggcagcggtgatggcagcctgcacgcgcgccacgtcggcgctgaacagggtgcccagctgggccgcagtctgcgggtgcttctcggcatgctcgaccagagccagcagctcacggacgaggtagttgccacggccgaacaggccggtgtagttggagaaatcggacttcagcatgttacctccggtaacggtcaaggatggatggacggcctgcacggatcggccctcgtcgggtcgccgccttcatgccggttggatcgttgatccagtcttggaactccttctgcgcttgcttctcgatggccttgttctggtccagtgcgagcttgctcacccagtgccggacgctaccctccagcgcgtcgattcggtcatcgtgcgcaaggctgccgcgttggctggtgatcttggcgagctggtggaacagagaatacaccgagcgcttgccgctgttggcgtgccgctgcgtgtactcgtgatccatttcgaccacgctctccagcacgacgagcgagccacgggcgatcacaggctccaaggttcctatgatgcgggcctccttgttgccggtcacgaactcctcgaccagcgagccgttccacttctcccgcaggattggcaggaacaccttggcgaaggcaccgtggcccatgttcttctcgatggagaggacgttcggcttgtacttggcagcgatttccgcgaggtggcgcaggccatccccgtcgtagccgcccggaaccgcgcccactgcgagcacgtacacggtggagttgaggaagccggtcactgcgaacgcggtctcgtctccattggcaccaccaccggcagggtcgatctgcatgtggacgccctgaagctccgcagtctccacggagatttcgtgcggggccatcatgatgaagccgatgccgctggactggaacgtgcgctggtgctgctgggacatgccgcgagtgatcgtcagcgggtagcgggttccgccgcccggaatcacgatcaggttctccgtcttcagcgggaagcgcatggcgtccatgagtctggtgttcagcatgtagttcagctggaacgaggacgggcctcggtccttcagcttcgcttgcagcttggcctcgtcgtaaatctgctcgtcggtcggctgcccctcgtcgcccatcgggccaccgccaaaggcgagggatgggtctgcttcgaggcgctgcacgatggacggggccagatgtgggccgtacgcctcacgctgtgccggggtcgggtagcggccgggccagatgcgaacgtcgaagccacgaccggggagcgtgttgtagatgctctcgctggtctgcggcgtgccgaggtacaggatgcgtgccgggattcccggacgaccagtacaaatggcggagaactccagcgtgatgttcagcagcagctcgcggttcgcggcagtgcggctgttcttgttggattctacgtcgtcggcgatcagaaggtccgcgcgcttgccgggcaggttgccggtgacgccgatgcacgccacggagggcgagcggtcgatgcccttcaggctgtgatgcacgtcgaacgcctcgaccgaggtgcggtcgcccgcgttcttgtcagggcgaaggcattcgagctgcggcacggtcaggatgatgcgctggatcagcgtcgccgtctcgttggcgttggtgccgcccgccgaaatcacgaggattcggtgctgcgggtcttggatcagctgccacacagcgaagatcgcggtgatcgtggtcttcgcctcgccgcgctgcgcctgcaccatcaggttgttcggcccgaattgcaggtagttggcgatgtcgtactgcatccacgtgggtgtgaagcccagcaccttcatgatgtcgcgcatgaagacggcgaagtgcgcgtagtgcttctggagcacagccagtttcttgcggcgcagctcggccgcctctgcggactcatgcgccattggctacgctccccggaaagttaacgatgttgtccagcgctgcttgcagctcggcctcctcggcctcggacacgtccttgttctccagcgtatcggccaactcgtcgagcgccttgttggcctcgcgcgtggcttggatgttgttgtccttcaggaacttgatcgcggcgttgatgtcggcagcggtacacagctcatcgttgcgcagccgctccttcaggaccgttgcgacgatgacgtgcagctcgccgagcgcgccttcacttgcgggattcgccattcttgtctcccatgatcttgcggtgttcgcgtgcgcgccagtagaactgtgcgatggcgtacaggatggcgagcgtggtgacgatggctgcgccataggtgctgatgaagttgaggtacaacgcccccgccgtgaggggcgaggtgcggacgacctcagaagccagtgacggcggggtcattatgttctcctataggttagggccagtcgtcgggattgccgacgagcttccattgcaggcggttgacgttgttcatgcctaccgcgatcaggtcgccggggattcccgaggcgatcacgtgttcggttgcgaagcgctcacgctgcgcgcgtacgcacaggttgctgccgttcttgtacgacaggagcacgtcgctctgcgtggcgaataccgctcgcttctcgtccatgcacaggcgcggggtggtagcaccggggatcaccatagtctgcatcgaagcagccaccgtgtcataccagtagaacttacacacgccgcccgccatgtacgccacgtgcgggcgcatggtctggtcaaaggccagtgcgatctgcgtgatccctgagtcggtcagcacggtgacgggggcaacgccgtcgcggtaaacgacgacgctgctgccatcactctcggcggtccacagcgcagcttggaggttgtccactgccgcgttgagagtcagcccgccctgctcgaagtcgatgagcgggcgggtgcgccggttctgctgctctacccagtcaccacgttggatgctttgggagacagtagggatcatggcgtgtagcgactccacgaaacgcgcatgcgcaggttcgccgtttccgatccggtcttcgtgacgcccggattgaagccgacttggaacggcacgcacgaactaaggcccatagccgcagtgatcgggccgggtggtacgttgttgatcgacatacggcacaccacatcgcggtagtacgtgccgggcacgtaggcaacgtactggatttgcagatcgctaaagctggacatgttacccggagggtactgatccgtgatcgcgccagtaccgtcgccggtgcctccgtagaagtagtagcagccccacacgtaatccgaccacgcaatagcagactgctcgttgagcgagccactgcgcccgagagcgatgggcttgcatgtcacagtggtgctgacgcccttaatcgtctcggtagtgacgaccggcgtagtgtccacatacatccgcagctcgtaggtgaccacgagaatctcgtccgacagcaccgtgatggtggtcgggttgccggaggagtccttgataagcgcgcgagtcgtaagcgggtaagtgccgttgttgctgttgtaccacttacccccaagctctgacaatacgccggtggcagtgcctgccgggaactggaactgcactcgtgcgtaggcgtagtacggagcggtggacgtgccgccagtctcgtaactggtgcggcccacctgcgctacctgtgcagcgagtgcggtgtcagtgaacgcaggctcggtgcttccgctaccaactgcaaggtagctgatgacgttgtagagtctctgcgcgtagccgctgccttggtcgccaaacgcgtccatgccggtatcggtaatcaggttgttctgccagtccgccactacttcgagcgagtcgagagacttgcccttgctgatagtgaacaggccggctactcccactttgttgtggatcatgcgaagctccatgagacgaagccgctccgaatcaaggcagtcgcgtcgagcggctgattgactacggggtgctgcttcagggtgaaagaatggaaggaactggacacccgagccgtctccgggtccgatgtgtagtccttacggatggaccggatgtcgaacgagacgaacgagcttccgtacagcgccgattctggatcggccgtgtagtcctgccgagagctgcgaagttcccagcccacgaacgacgaaccaataccggcggaatcaacaggcggtagcatgtcgatgttgctgtaaccagcgaaactgctggtaagcatcgcggcgtcgaactggtagaagctgtagagcttcgacgtaacgtagatgccctgctcctcgattcgcccggaccagtaggccacacggttcaacccgtccgtgaccttgatgctcaggaagtaggagctgtcgtcgttctgacccagcacgtacttgtggttccacttaacggtgtctacccacagcggcttgttctgcttgctgcggaatgcggacaggaccacctgcacgtacttcgtgtccttgggcgctgcgccctcggcgacagactggtgccatgcgccgttgctgccggaggaaaccatgttgccccagttgcgttgcagctcggtcccatcctccttgcggtagatgagcgacacgcgcgcaccggccttgcccttggagcttgcgccctgctggacctcggcggtgcatcggatgtagtcgttgaccttggcaggaatcagcgggttcagcaggtcgctgccacccgtcttgatgtcggcgaagcgcgcgctgtatacgccgctgtcggtatcgtagtcctggccggtgccaatcgaccagccttcgccgttcgacccgccgcccggcacccacgtgccgtcgtcgcctgcctcgaagtcgccgtttggcacgagggtttcctcgtccacgacttcagtgaaagccgcccacttgacgacgacttccttggtgatattgtccactcgtaccgcagcgcccggagggagcgtcgattcgatgacctccacggtgcagcggccgactgggttgttgatggacaggcgagactcgtaagcctcgcccgccgtgtacccttccagcacgcccgtcaccgacaggccatctgcaacctcgtccgccatcagcggtcggccgtacagcctgaagtgattagccatgcctactccttagccaagtcgcccgagagcaaccatgtgttggtgtcgccgtcgatgcacgttgcagtgacgacggagttggtgccgcgagttgcggcgatgcagccggctggtacttcgagagttacgcccgcgtcgccggtgatgaccaccgggcctgccttctgctgcacgctgaagtagctccccgaggcgagcttcgtctcaccgtcgccgacctcggggatcaggttgatgttgacggtgcagcccccggcgtacgtgcagcgcacgagtccgtactcggtagccttgtcggcgtagtaggtcggaccctctgccgggatgatcggcacccgcaggctcgtagcggtgatcggcgcaggcccggtgtagggcttggcgtaaccgcgcagcacggcgaaccagatgcttccctcagcgggaaccgtggcgaagcggatgaagctgggatcggttccgtcagcgagcgtgacctgatagtccacgtccggctgcatgccgataccgttgacgtacacgtcgtagaagcccgcgccggatacgtccgcgcccaccatgtcgaagtcggtgtcgtccgcctgatcgccagtccaagagccggaccagacgcgaggggctacggacacgataccgccagcggccagaagttcgaggacttccttgtaaatctcggtgatgatcttgttcaggtccaccaccacgccgacttgctggtcaatgctaagggtggcgatgttcaacgaatcgaacatttcctgaatgatcttcagcaactggtcgttgcttaggttaaggttggtcttgctgatgatgctaccgttaacgtagtcaacgagcatctgctgcaccggagtgctgcggtagatgtagagcttgcgcccagccgcgacggcaggctcaactcgcacggtcgaggagttctcatcctcggacagcacctccacggtgtgagaggtccggtcggtaagcagctgcgtttcctcgtccagaatgccgctcatcgcgtacacgtgggacgggtcgatgtagccgcccgtgaagctgatttgccagtcggtagtgacgccattggcgtcgaatacgtccgtcgcgtagcgcagctggggatcgggaactgccatgctgcctcctgtgtttgtcgtatgtgtaccaaaagtcgggccgtccttggcccgccagcgttattcctccagatgcgccgccgcgcccttcagcagcgggatcacgtacggcaggcgtccgcccggcagcacgtcggcaaggttctcgggacgcccgctcacgccctgcgcgaagtcgttgatgacccctagcgccggggcgaagctgccacctacgatttccttccggttgccgagctgaccgcccgcgagctgccgcacccagtccggggagccggtgtcggttgcgtgctcgtaccagccacccgccacacccgtccccacttccagcacgtcgccgaggaaggccgttgcgctgatgtagttcatggtgctgcggcccatcgccagaggcgacagtgcatcctcgatagcctgctcgcgctgctcctccggcaggaggacagcacgcgaagccacacgcagggcttgcagcggggcaaccacggccatcgccgaagcgatgataccggcagtaccccatgcgccgtacaggcccatgtagcgacccagctgcttctgctgtgcgaccagcgagaacgtgcggtgctggaacagcatcttcagccaaccgttgtgcgcccacttgccggtctcaccgatgaaggtgtcctgcaagatttggttcgtaccacggtcgatggcgttgtagaacgcgagccacgcctgccggtcgtgcaggttctccagaccacgcgggtccacagcctccagcttaccgtccgcgccccagcgcaccacctgatcctgcgtctgccgcaggcgagcaagcagcgtgtcgtcgaggcccatgtccttcagggcagtatcggcagccttgccgtcccgcaggaacttcacacccttggcgatcagcacctccgcgaagccgcgctgctgcacagccagtaccgcgcgctgtcccgagaggatgcggttggcgttggcagtgcgctgggccagagcggtcaggaagcctgcgcgctcggagccgtacagcgaagcctgcgtgtccatcgagttgaacatgtgcaggtcgtaacccgcaaggccgaagccgcgtccgctgatgaactcgaagccgccgaggatgctgttctccgggtcttcgccgcgcagcagcttgccgatttccgcacgcatgcgaggagcgattcggatggcttccgccacgccagcagcgccgacagccgggagaccgttggagtattccgccgcttggttgatgcccgctccgcccagctggatagccgaggtcagcagccgcgcattcgccagaacagtcggatcgcccgtgccgataacacggcccgtgaactcggacatcacctgatcgaacgcacgcagctccacgtcgttggcaccagtaacctgcatggccttgcgcagcaccgagataccggcgtcgcccatgatgccgtgcttcgccagagcgatgtcaccagccacacgacccgcgtacttgcggtagttgtccatcacgcggttgtccaagtagtccatcaggcggaactcgccctcggcatccttgtacttgcgcgtcacgtccaagtcgatacggctcttggtgtgcttcgcaccgccacgcgagtagcggcccatcaccttctggatttcctcctcgttgagcgacagtgcgcgcagggtgtcccgcagagtgtcagactggttatcggagaacaggttgtccggcgcacggttcatgcccgcagcccgctcctcgatccgctccagatacttgatgctcaggtcgtcgaggaacttgtccccgtacagctcgcccatcacatcgaactggtcacgcagtgcctgccggatgctctcacggcgcacgcgcccagccgcagcaatcttgccgcccagccaagtgcgggactcgtaaccggccacgtcaccatcgggaaggcgggaagaacccaccgtaccgacagcgcgctgctcggcagccatccggttgtagccttcgtccagcgccttcgccatctgcttgatggactcgtgcgcgtcggcaatctcgcggcccatatacatggtctcgcggtacagcttcacctcgtactcgaactcgctccgcatcttccagccggtggcgaagtccttgatcgcaccagccttgcgcacgtcggcgcgccacagccggtaggccgcttcccactgacgcgggcgcgaacccatgaacgactcgaagcgaccgcggcgatccatcgctgcggtgctatgccgaccagccgcgccttccgggttctccagcagggtgacggcgatcatgcgagcgaccggggactgcgacgacatgagcgtggtgctcgtcgcctccagcccgaacttctgcatgatggtggacagcttctccgcgtcgatggcatacttgccactgaagcgctcggcgcggccgatcacctcggcgacttggattcgggtggcgctgtcgctgatctgcttgtccagcccggtgcgctgcatgaaagccttgcgctcgcggttgttcttgaagatcgagttgaccagcatgccacgggtctgctgcgaggcagcctgcggagagcgaatctcctcacccaagttctcaccgaccacgttcatcaggcgctccaacgcagactcctgtccggtcaggcccagtacgcgggcgatcttgtccttcagccattcccacgcggtctgctgcgttgcgcccggaggagcgctgatgttgcgcagcactgcctgcacgtcgcggttggtcagaccatacgacaccagctcgtcggtgttggcgaggaagcccatgcgctgctgatccacccggccctgcatcgcctgagtcatcaggttgcggtccgcctcggacaggttggcattgacgtgcgtcagcagctcgtccatctgcgccttgaagttcgcatcctgccgcagcgagcggaaggttgcggcgtgtagcatttcgtgcagcaccacctcggcgttgtgcgcagagctacgcatcgccatcgcgttgagcgacgggttgtacccaccggccacgttcggctggttcgggaaccactgagccagctcggcgtcaggagcgatgcggacaccattcaaccgaccgctacgcttcagcgtgttggcgattgcacggaagtcttccggcacgttcttcgaggattcgaggtaacgcagaatgtcatcgggcgtgcccttgataccgctcgccttccacgcacgggtcagcagcggatcggccggagcgttccactccacgcgcccgcccacgttgtcggcgtagttgccggtgctcgggtccacgttctccacgtcacgcgccagtgcgccggtagcgttcgaggcagccgaggcttcctgcgccacgtccgggcgagcgaacaggcggaagtcgtccggtacgtcagccatgcctgcacgaatccagtccatcacctcggctcgcgcgagggagtgaatcttcgcgttgagcgccaccgggttgccctcgcccacctcagccacggcgcgtgcgcggaggtccgcattccactgctcgccgtacatggcggcgttgccggaggccaagtcgatggtggccttgtcgcggacagcagccgcgctacggataccgcgcaggttcatcgccgtgccgataccagccgagaaggcggcgtcggtcatgaagtcggcgacggtgcggttctcgcccatgcccaccagtgctgcatccgtgatgacggacgcggcggcgttctcggcgacactcgaagcgatgcccgcagccacacggccttcagcgaacagagccgcagagccgacgcccagcgcgcgcacaccaccggaggccaagccgccagtcgcccagttacccggatcggtcaggcccgccacgaggtcgtagccgaagctgccccagccggtctggttctccttgatgcgcatgctgtggcggcgcatgtagatgcgatccgtcacgtacgacagttcgtccggggagtatgccgcatcgcggatgtcctccagctcgtcggcggtgtagtaggacttctcccactgcttcgggtcgtacgtccaaccttccggcgtcacctcgcggtcacggctgagctggttggtcaaggcagcaccgatgccgctatcgaacgccgcgccccacttgtcgaggaacgacagcgagtcacggaacgcaacctcgtcccggtcggactgggtggcagcgatggcagcgcgagtgttgcgctcgttgctctgcgtgtcgatggcagagacttcttgtcgcacccaccacgggaccacctcgtcgctaccgcgcacggcctgcgccgcagccacgccctgctcggcggtgccaccggcgatgacgttctggcccatcgccagttcgcccagcccttcgcgcaccttgccgatgtactccttcgtcgcacgggcgagaccgctgcccgcgccttcgatggcatccccacgccatgctgcggggatgctcgccccgctccacgtctgcgtggtcatgtttcctgcaccggcccaagcggcactgatgccgccctgactggccgcgccctgcggagccacagccggggcagcctcgccgcccagtacagccggagcgtacgccgcattcttcggtccccagttggcacggttggtgccgccgtggtagatgcggagtgcggtcgtaacgtcgcccttggcaagctgcatgttctcgcgcatgatgtgcgcgtacatttcgaggttgtcttggaagttgcgcacgtcgtacttcttgcccgtgcgcgcttcgatgacggcctgcgtctgcggcatgacttggaagtcaccgcgagcgcccgcctcggaagtgatgatgccctgtgcattcttctgtgcgcgcccgttgccggattccacgcgccactgtccacgcacaaccgactccggcactcccgcgtaagcggcagccgcagcgatctgctggtcttgggtcagccccgaaagatcgagtgccattgtctaattctccttagagtttgggttggatggaaatgctctgctggatgctaccgtccggcatgcggacgtagccttgcggcaccgggaactcggtgcgggtcgcagccttgcggcggcgttcgtactcggccttgatgtcagcgccagtgacggcgacgaccttccagcccctctcgccaaccgtgttgacgtacagcaccggctctccggtctcgctatcacgcatgcggaacacgtcggccttcaggctcttgctcggctccacgttgttggcgcggagggtggcgtcgattaccgcttcgattgcaggcccggtctccttggtgtccatgaagcccagccatgcgccgacgctgccgatgacgtgaccttcgtcgtcacgcccgttctcccagtaatacttgcccgcatcctcgccgccgtacttcagcttggcgagattgagcgcagcagtgataccttcggaggacgtgtcgagtagaccaccggactcgttgaccgcacgcacgattgcacgcgcagctgcggcccggccggagtcgcccagcttgttgccgaagtagccgaagtaggcggggttcgccttctgcaacacgtcagcaacgcgcgcctgcaacgcctcggattccttgcggctgcttgcactgaactcggtcgggtccgcggtggtgatttccccacgcgccacctcgtaggccagctcgaagttcacgccggattcctccagcgcttgcagcttgttgaacatcgtgttcacgccgtcgccgaagtacagggctgcggtggtcgcaccggacagcctaccctcgacgggattgccgttgatgtcgatgcgcttggcagtcgtgttcttcagcatgcgccactggttgtagaggtcgcgcgccgcgtcgttcggctgctcacgcaggaccgcacgtgccgtggtctggtactgatcggccacgcccttcagcacagcgccgcgtccagtgttggcgttccacaccagctgcgacatcgccactgcggggttcgtctgcaaggtctggttgaagccctgcaccacgttcgcctccagcagctccttgtccacgcccggcacgttgatcgtctgcgagtacgtgccatgccgccacgagtcgatggccgcccggatgtcctcctgctgcgccgccagcttcgcctgctcggtgttcgccgccttggcagcagccgcacgctcacgcagcaccgcttcctgcgcgcggatgtgcgcgcctgcggactgggccatcatgctcagacgctgggtgccggagtacagcggatcgtcgctgccggtcgcggccgcgtagctcatgttgagctggtcgatctgtgcctcggtcggcttagcaccgatgccctcggcagcgtacagcgacacgagcgccatctgctccgcagcctgcgggttgttgtccagccactcggacttgtactgcgcctgcttctgcttgacgtacgcctgcaactgcaaggcatcgtccgggtccagcgccgacagcacgccacgctgactgaggaacttcagcgtgtagaactcgccacggtcagcagcgccacgaacgaacgcggtcatcgccgccttgtagctctcgtccgtctggtaggcggaaggcgacagtccgtccagcaggctcacctgcgactggatcagcttctcggcctcggcttcatcgccgggtgccttgttgcccagcagcgccacgcgcttcgccatttcgttgtagctggtggagttgctgctgttgctcgcgtactgcgccttgaccagctcgctctgctgccacgccacgcgctccttggtgtgcaggtccatcagcggaccggcgcggtccatgaaggtcttctgcaacacggcgtctgcgtagccgttgcccgtcatctgagactgggcgagcctgttgaactcttgtgccatcgcttccggcggcagcttgcgcagctccggcatgcggtggatcaggtcttgctccatgtccgagaccgaacgcagcacgttgtagttctgcgcgccaatctcgtagttcgtgggaccgaacagcttgctgtaccacggctgctcggcagagatttcgtccatcgtctgcccgctgcgcgccgcaacgaagccatcccacatctgctgctgctccagcgccttgcggttcggggcagtaatctcgttcaagaactcggggagattgctgtccggcatcgtcatgccgccagtaccggcgaaccagtcactgccgctgcgtaccgcctgtagcggggccacgccaccaccttgcacaccggcctgcggaacggcagcggtcgcgccaagcgaaccgccaccgaccgtctcggtgctgaaggtgatcgtgcccggatcaccaatagccattaccatgcacctcctgaattgctcccgctaccgaaccagccgaggccggaggtagtcgtggagaagttgtcgtagttgttgccgaactgcgtggtgatcttcgcgcccgttccggtggatgcctgtcggcccgtgccgtcgttgtacccgaaggtgctggacgcccacgacttaccgccgcgctgcgaagtctgctgccacgccgacatgccattctggatgccggagtcgaagctcttgctcatgccttggaagtcaccgttctcggcctgccacgtgccaaccgcgaagtcggccacggcctcgcctgccatcggcccgccgaagtaggttgcgactgcaacgccaatcagcttgcccaagcggcgcttcatgcgcttcggctcgatgtgctcctgatagtcgaactggccgaacgtccggctgatgtccatacccttgtaggcgttcgccatgatctgcgccgtctgcgcagcgcctcggctcgacatgagctggatcgcgttctgctgcgtctcctgatccatttcggactgcaagcgcaccatcgtgtccatgaggtcggcggacgaaccaccgacacccacaaacccggactgcgccgcgagggcaccgcgcgccgcagcgagctggacctgcgtgttgaggcccgccccttgcttcgcgcgcagctcctccgacagctgctccatctggaagttgtactccttcgaggccgcgttcaccttcgcttggttgttgagcgtacgcatgtactccgagaagttccccttcgccacttcgagggcgttggtgttcttcgtctttgcctcagctgcgcgccagttcgctcgtgcaacccgcgtggtgttgttggcctgaaggatagtgtttacgctacccactagctaaccctccgcacgttgttgaaagtctgaccaacccacgacaggcccgtcactcggagcgggagccagtccttggagctgatcgtgtagctgcactcgcggacctcgcggcccacggggatcgacagctgcccggaatacaccggctgctgcccgaccaagttgtcgctgtcgccgaggatgcggccctcgaagtcgatgctgctctgcacccggttgcgcgtagcgaccacggccaccatgcctgcggtgttctgcacgtcggcggtgacgcggttgagtgccatgcggccgtccagaacagcctgtccgttctggtctcgcgggaacggattggtcggagtcaccgatgcgggactcaccacgccgaactccagcgccgcagggtcgaggtcatcgaactgcgacaggaactccgtgatgcgcgccagtggcgtgcccagcaggaagtagtcgctcgtcgcgttgaccacgacggagccatcggccacaccgttctccgtgcggttcgcgtacgcgatgcgagagtcgatgtacccgtgctcgtccagctcgcccttgaagtccagcacgtcggccaccacaccgcttgcgcggccggtgaacacgattcccgacttcttgaacacgctcacgccgaggatgttccccagcgatgccgcgtactggaacttgctccacgcctccagctgccgctgcccgttgttcttgttgtcctcgtagcggtacaggtagaacgtgctgggctgattgcgggtgcggaacagcaccacgttcggtgccgtcaccgtggcgatctgcaacggttctcccgtcagccagttgtcctgctcctcgctcagctcgtcggtcactgtctgctgcccgttgagggcacccacgcgcatctggtgcaggctcacgccctcgctaccgtactgcgagtagaagatgaagttgccggaggtctgagccttcgcgtcggtgctgtccttgtttgcgctcaccgcccggatcagcggagacttcggagtcagcagcgcatcgccgctcacgccgtactgctgccgctcaccgaagatgatgaggttgccgttgtagagcaccgcatgccgcagcacgtcgccctcggaaccgaacgcgaacatttccaccgggtcgtcgtcggcgatggtcacgacgcttccgcgccagaagtcgaggtagtccccgctcatgctcgcattgacgtagttcgcactgcctacgatcagccggtcttggaagacagacaacatcgtgatgggcttgtcgatgaaccacgggatcggagaggtgaggccgtcaccgaccttgcgctcgccgtatgcgggatggtccccgctcgccgggaagatgctggtgatgcctgcaccgttgcgagcgatgcacgcttgcccgttgtagatgtagagctgggcgacaaggttgtcgatggtgcaggtcacgcccgcagtctcgaaccagtccaccgagccgtagcccgaggtctcgccgctctccagctcagcgcgcaggtagtacgcctcgtccgcgcctgcgccgctcgggcgcacacgaatgatcttgccgtggaagtggtacttggtcgcgtaggtggcgtcggtgatttcctgccccgccgcgaagaacgtggtgccgtcgccttcatcgtccaccgtgatgtccacgaactggtcatcgtcgatgaggatggaacccttcaggtaggtcgaggacacgccctcgtcaacgagcaagtccgacaacttctcggcgatgtactcgggccgggtctgctcggcgctcgtgacgatccactcgttgactgcggagttgtactcgttcactcggtcgttgacgtgcttctggtacgccgggtccggctccgtgccgccgggcaggtagaacgggatgtcgctcgtgtcgagcgtgccggggtaggcagccgtcaccgtcttgtacgtcacctgcaacgtggtgccgtctgctcggtgcaaggtcacggtgtaggtggtgttgaacttgccggtgcgaatccacgcggcgagccggtgcaggttggtctcctcctgccagaggttggtgctggtcgcactcggacggttgtcgttgcccgcgatgtagacgtaactgccgatggctgcgagcgacgacgccccgcctgccaccaatgtgttgacccacgagctgttctcgtacgtgatcgggatgaactgctcgcccgtcttgtcgtacaggaacgcgaagctcgcggagccgagcgccgacgccttgcggcgatacagcagcgcgtactcgcggccctcctgcgtgaagtcgaacacgtccatgtcttgcagctcgacgcgcgctgcctcgctcagggccagaggcagccgggcagcgaagcgcgtaccgcgacgacgcacaagcccttcgacgggatcggacagaatgttgatctgctcggtcgtctgtcccggtcggcggcggtgcggcggcttgccgctcacgccctgcacgatgtccgggtaggttccgcctgcctttgccatgatgcctccttagccggggaatgtggtgtggctatgccacggatgcccgctgtaattgaacacgcgctgacgcagaacgtccacacttgcccgcgcatacagagggtttgccttgatctgccggatgtgctccgacttcaggttgatccagcttagctctcgctgttgcagaatcttctggtacttggtgttgtcgccgtcgaagtccgactggaagcgcagcacgctgtcgtcgcgcacgaacatctgcacctcgtaggggcagtcctcgaagtccagcagccgggccaccttgacggtgacggggccatcgaactcgtacttgttgcgtgcgacatcgtacagtcgtcggccgcgctgggccacccgccgcacgccgcagtgcggcaccgggtccaccttcagcacatcggtcgggaccatgatgtacttgctggtggcctgcggctggagcttcaaccactccacgttgaaccacagcgcgagcgacgaggtgtcgcgcagcacacggtccacgaggtcgagggcatcatccttgtacgggtgatcttcctccagagtgttgagcttcgtttcgcccatcgtcttcaggcaggcgttcactacgtccaacttggtgatgaacatgatgcctcctagggaacaaggcagagagagcgctgtgctctccctgccggtggatcagtcggccgcgagggtcacggcggacggggccagctcgaagtcctgcgagccgttctcgtcatccttcacgcgcacgacgatacgccacgcatcatcgcggccgaagacggcgacgacggtgcccagcgtaccggcctcgatgcccagcgacgcgatggcggcggtgatcgaaacgcggttggaaatctcgaaggggcggtcatagaccattgtgtcttactccttggtagagggcgcagtttgagttacccgagggattcagggactgcgcccggatggattaggcagccgcgtcgatgcgaccggccagttcgacgcggttgaagccgacggcgaacgacatccagctgtccacgaagaagcacttcgaggcgtcggaccaccacacgctcgactggagcggcagcgcttcggcgatcagcagcgcacgcggcgagaccgccacggccacgaggccggtgaagtcgccgtcgtagaagttgtcgttgtcctcgttcgacagcaggtggccttcgaccacgccgttcggcaggttctcgctcgacaggaccgggacgccccacgccttgaagaccgggatgccggtcagccggttgccgtcgctggtcaggtactcgccgttgacgatctgctcggcctgctggagggtgtagaacacggtcgggcggacgatcaggacgatgccatcgcgctgcggcttgaccttcttggtctcctccatttcggagaacagcttgccaatggcagcgtacagcttggccggatcgttctcgtcaccggcagcggcgagcacgacctgcgtggcaccgaagtggccctcgggcgcgcggccgttcttggtgaaggccgaggtggtcatggcggcagccttggcagcagcgatgctgatggtggcgtccacgaactcggcaatctcctgaccctgctcgacagcgatttccttgcgggtgtcgatgtcggtgaagatgtcgtccagctgccagatggagtggcgcgacagcagcatggtgtccacggtcacggacgccttgctgaagtccacctgcgtgccgtccggcgcgtcgccgcgcttcagcttctggagcttggtgcggccgatggccttcttggtcagggtgttggtgcccttgaccggcttgcgcgggaagaacttctccagcacggagctggaaacgaaggtgtgctccacgtcgccggtgaactgctccagaatcagggcgttctcgttgccctgctggttgatctggttcgggaggaccggaacggtcgggaagatggtgctcatgttgtagtgatgctcctaggttggttagtggatgacgcgagcgttcagagccttcagctcgtcggacttcgctgcaccgctgatgcccagcttgtccaccagcttgcggtactctgcacggtactgctcgcgggtgagcggggcgacgccctgcaacgactcggacacggcagccggattggtagcgggctgtccctgcacggagacgttcgggttcgaggacgcgaggctcagcagatgccgggccatcgcaacggcagccaagccgcccgaggacaatgcctcactggcctgcttcagctgatcggcgggcaggttggtgcgtgcgtactgctgcacggccttccagttcgcctcaccacccacggcctcgtggaccttggtgacggtttccttgtgcttcgcgtcggcggcagcagcgatgcgggacaccgagtccttcgccaatgcgaggatcgggcctgcgcccttggccttgtcgcccagcacttcgatcttggcttccagcaggtggaagttgcccttcgccgcttcggtcagctcacgactgttgatgtcgagacccagcgtgttgacgaagtagtcggccgcgatgttcaggccgttgtcgccgtagtccggcagctcggcaggagccggagcctgcggcgcgctcggtgccggggcttgcggttgcggagcgggttcgaggttcagcgcgttcgggtcggccgctgccggggctgcgggagcctgcggctgcgccggtgcggcgggctggttcggctggaccttgatcggatcgtcggcggcaggcggctggttgccgttgggctgcgcggtcgagacgatcacgtttgcgttggggccaccgcccggaggtgcgttctgactcattgggtctccatgttgttctggttgtcgatctgctgcgaggcgttctgcatggcgagctgctgctgctgtcgcatctgcatcatctgcccgaactcctcctcgctcagaacgtaggttgcgggatcaaggccgcgcgctgcggcaaggtcagcgatccacgcggacagcttcaggcggtcgagaatctgcggaggcagactcagcacgccgctgatgtcctgaccgaagcccagcagtcggtcacggtccccggtgcgcgagagcgcggcgaggccagtgatgatgacgggttcgatgtcggaaccggcgatgctcttgtcgatcagctccatgacccagtaggccacgggaacctgcacgtctacggcgatgcggctgtagccgccacccagtccaccttccagctcctcggccaccatgcggatttcttccgccgtcacgcgctcggcctgacgagtcaccgccgtctggagcaggaagcctgcgccaatgcggttgatgtagagctgctggatgttgaggttggtctgtagcgtgccttcgacgccggagctaatcagctcgatgtcgcccttctgtccggggattgccgcgccgttgggcgaggccacgaagtcttcgacggaagtctgaccagcagggttcaccagccaccggaactcggaggcgaggatcgctgcttggatggtcgcttcgctcaggagggacagcgcttggaagtcgccctcgtagtcttccacgaggccggtgccgtagtcgtcgcctgccgccaagtcccacgtcacagcgcggtagggcagcttctccagagtgtagctcgacgagaagttagcgggcagctgcacgttgtccagccacactgtctcctcgtacttcttgccgttgaacttcacccacttgtactcccagcagttgccatcgtcgtccggcttgaactccgggttgccgatgactgcgccgagtgctgcgggcttgatcgcggacttgtgaatcttctcgcggatgatgagttcgcacactgaaccttggcggtcgcgcttgacgacgtagttgcggaggttcagcacgcgcaccgtgtccttgtcgaacaccatgagcgcgttgcccagcacgatcagcatcttcagcaggtcgtacagtctggcgcggatggagcgcttgtccagctccagcgaggcttcctgctccagcttcgcaagctgggtctggattgccttcgggtccacaccggcctcgctcatcgtggcgcgggccttgcggttcgcctccagccggaagaacggccgggacggggcgaacagggacatcatcagcttgttggcgaggtggttcaccgcctgcgcgcccagcgactggaagccgtgggtcagcggttcggtgtcctgatcgcggttcttcttggggaacagcttcgggatggtccacgaagcgtagcgctccagccggtacaggataccgttgcgcttcccgtccagcttctcgtagcgctggcatgcagtggttgggtgcatcggattgtccatgctcacctcacaggaggtccgagccggaggttccggtcagacgcgattgggcggtcgggacgattcgctggtactgctgccgggtcgtacggcggcgaccgatcaggtcgtcggtcttcaggtcaaggtcggaggttccgagcgtaacgtccacggtttcgatgggcgcactcagcaacttctcggcgtactcgctcgcagcctgctgggcggcggcggtagccatctggtcggccattgcctgaatctggtagttggtctgttgggtctgaaggttggtctgacggtcgatggcagccgcttgcttcagggctgccttcttcgccgagccacctccgacgagggaacccataggctatctccttcgtttggtgagttgcggcgaaccatcctccagctcgaagccgaagcgttggtacagccgagtgattgcccgagaggatcgagctagtgctccgcctgtgactatggcatcgcaatcgttggtctcggccagatgctccagtgtggcgacgaccgccttgaaggagctacctttaccgatccgtagtaccaagtcctcagacaggactagcctgttcttagagtaccaaggtttcactacagagaataccagtaggtagctttcgtctatcactactgcatctaccatattctgtactaccatttccacagtgtactgtggatcgtcacagaggtagcttactgaggagctactatgctcactctcactcggggctaaagacagatacagggcagcgtctagcgccaccctgatccgctctctatcacccgtcgttggtgttcggattgctggactcaacggtgaatccctcctgcaaaatgcggagaactcgtgccattccgatctgcacacctgcctccaagggcgtggtgttggaattgacggagaggacggaacccgcctgtcgctgcacggcagccagttgcttcgggtccagtcggtagatgatcttggtttcggacatgaggtctcctctgtcgtatgtgtaccaaaagggtttgatgcctgccccggagggcgaggcaccctttgtcgtatgtgtaccgaaactccttcagctgaagaagtacggagaatcaatgacttgcgtgaggtcgaggtcgcccatcgggggcggctcggggaggaagccgtaggccgccctgaactcctccagcacgtcgtgccgggcgtacatgtccacgaagacctcccggatgatttcgtacaggcgggctgtgtcggcggcgtgggtgccgtagtcgtcgtggatcatggcgaaggcgtcgatgccttcggccttggcccggttgaccaccagcgtcaggtggctggcgtcgaggctgtgtacgaagttgggggcgatgccgttgcggtgccgggacttcttcacctcgtccgtgctgcggcgcacggagagcttcgcgttgccgcacagcttggtgttgatccggtgttcctcggtctcccagtacacctgcgtcaccgggaagccggacggcgtgatccacttgatgcggtcgtagccctcgcgcaggatcgccgtggacgccttctggagccacgccattgcgtcggctgccgccactaccgtgtcagctatggcgacgcccaggcgcttgctcaggaagcgtgcggccttgtcgtacagcttcttgtccagctcggggaacttgcccgccttcaggtagtcgctcacgatgaagtccgcccagctcgattggcgcgagccgtagggcagggtcatcaccgagcgcttcaccagcgagcgggtcaggccgtggtccagccacagcctgcggaacccttcctcgtcgtcctcctcggcttcaaggatcttggtcacgaggtccgccaccatctggtagatgtcattcggaagcggtgccgggatcaggttggtcgccttcccgcctgcactgtcgcgcagcatcgcggagaagttctgaagtccattgcaggaaccatccatgccgactgcgatgcggctctggaagcgatccccgaatacctgccactgctcgtactccaagcaccaagcgagaaattgcagcggcttgtctgcggtcttccactcgtcgttgttcaccgggtccgcagcaaacgccagaatctggtcgtgatgctcgaccacccacttcacacgatccggcagagacgccttgtcgtatccccatcggtttgctcctgtgatgcagaaccagtccttcgccgacttggtgagcaagggcttgccctcgccgaactccagcagcgccttctgcaagtccgaaccttgcggcgagacgccggtggtctgtacgtacttgcggccacggaagtccacgaagtagacgaagtagattgcttggtagtccacgaacttgcgcgccactcgcatggcgttgtagaagcgattgctcttgctgttgcgcaggcgctcgtcggtgtgccagtcggccacctcgcgcttccacttcttgaactcgcgctgctgggattcggacatgtcctccttggtcatgcccttctccaaccaatccggcttgcgcggcttgggcagctcggcctgcgaaatgatttcctccatgtcgtgaacctgcgccactgcggagacagcctccagcatacggcggttgatccgccacggcacgcgctgcaacgcattgaccgcagccatctcgttgcgcagctcggcgctacggtagtcgtcgcgggtctgagcgtaggtcttcaccatccacggatgcagcctgcgcatttcgttggtatggaatccgccgttgtccacgtccgtccagtccttcggcggctcgacgcacggcaggaagtacggggtgctctcgatgacgaactcgctgatctggtggatcaacttgcgcacgtcctcggtcaactccacgtgcagattggtcttggtcttgcggcggccaccggacaccacgacctcgttcatcacgccggtgtccaccatgcccatctgcgcaagctgatcgacgaggtagccgccgacctgatcgcgctgtgcttggccccactcgtggaactcgacgccgttcttcctgccctgcatcttcatcacggtcatgcggtgcgtctcgttgacgctcagcttgcggtccatgtcgttcatcaggtggtagaacagcgtcggctccgcgtcggcgaactgggtcagcaggtactcgtggtacacgttggtgcccacctgcttcaccacctcacgaccggcagccttatccttcttgccctgctcggcgatgcaagccgccaagcaaccacgtacggccacgaaggcgatagcctcgtaccattcggtggcttgttcttcggcggtgatggccttcccacgcttgtccttccgctccgggtcgtacttcgcccgcagaagtggcacgtgggcctgcgccctgccgatgcgcggcttgtcgatgtcagcccggatacgctccgcaagcggaagcacgaaccggcgatacaccgcctgagcgtaagggttgttcggcgcgccgccgttctcctcgttacgctcgatggccttgcgcatgcgctcttggccgaaagcataggtctccagttcgagttccgcttgggtgagcatgctacctccggttgtgtgcttcgtcgaggactcgcgccagcgcctcgttcacgacctcgcgcaggtgctcgttcgggaacagctgctgggcgtagtcgtcgaacgggatggtgatgctgatcccgatgctgcgggtgagttcttggtgggtgatgtcgatgcggacattgctactcatcggtccgcctccgccttgtcatgtcggattcccttgtagcgcggctcgcgcagcaggccgtacttgctcagggacatggattcgatttccacgatgtccccgatgcagggcagctggtccgcgctgtgcggcacgccgctaccgacttcctgctccttgccttcgccgaggtccacgaccaccgtccacacgtcgcgcccggtcttctctccggtgctcatgttgacgcgcagcactcgcaggtccagcgtcagggtgggcttgatcttgatgacttcacccttcgttcccttgtcgcccttggtccacgtgccgctcggcttgcgcaggatcagcccgtcgtacgggccgctctcgcacagcaggcgggcggcttccatcggcgacagctcctgatccacgaggaagccttgcgactccgcaaggaagaacggagccttgcattcctcgatcttgctgagcgtcgcgggcaagcggcccacgcggtcgaggtaggtcagcgggctgaagccctgctcccactcgccgatgctcacgaagtcgaagaccacgaagaacggttcggtgtactgcgtgccgtccttcttgcggaacatgccgctcacggtcggctggtcgatggtcgggtgccagtattcgccgaggtacactccgatgggagcgaacggcgcagcggccagtgcttccttgatgtggttcgcggacaccacttcctcgccggtgcggctgaagatcgtgatgtgctcggcggcgttggcggccttgaccaccacgcagttgcagccgtcgtacttgggctgtgcgaggtactcggtgcgcagcgcgtcgtcgctggggcgcagacgcttctgcaccttgtccagctcgacggccttgtgtacgatgtagggcttactcatcggccttggtctccttggtcgggaggttgttgcggacggtcagcccgccgacgttcgcggcgatgcggccggacatgaagtccgtgacgatctgaccgatccacagcttgcgcggcaccatgccgttgcggtagccttcccacgcatcggcgatgcgagcgtacagctcggccttgccttcgtcgttcaggccggggaacgcggtgttgaccgcatcctgcaacgcttcctcgtgaccgccattgccccaagcaacggcaccctcgtaggactggatcagacgctgggtgttggacttgtagttcattgtgtctccttgttgaatggaacgaaacctgcgagacccttcatcacgagtatgcagaacgcatcgtcagggtatgtgcgatgccagagtgagttcgcccactcggtatcgaaatgcttgcgggtacgatgctcctctaggaagcgcgcccactcggcctcatgtgggacgtaccgatgcacttggccgcagcgggcgcaggccatcagtcacccttgctgaaccagcggcggatgatgtactggcgcacgaagctgatgagcgtgaacgcaacgccgatggcgtgcgccgacagcagcgggtgctcgggatgccacagcagcggcagcaacgcgatgttcgcgcagtagttgatgctgtacccgatggcgatgttgacccacgcctccttgatggagcgcttcttactctgcgccacgggccttctcctcgcgcagctccagctccagcaggaacagctcgttgatgatgtggtgcgcccggtgccggatgccggtctcgggatcgaacagctcgccacggcagcgcgccgcgtcgtgccggtagctcgcatcctgatagcgctcctgcccattctcgacgtgctgccacgagtgggcggcgtacttgcgagcgccgaaggtgagggtgcggacgacctcggccagtgcgagcggcatgccttggtgcagcagccgtggctgctctttgccgccgtcgaacttcaggcccgctccgcgttcgctggtcggcggggtgcgttcgtcttcgttacggtagttcagttgctcaggcaagggaacctccctatgtgtggtggtgatgcctcctacgctcatcaggcgagtgaggaactgggccttgacgtaggactccttcatcaagccgtcgaagcggacattgatgtactcgttgcagatgctatgcaccacgccggacctaccgacgaggcccggagcggagccggtatagcgaacgcggtcgccacggcgaacatcggtaagtctcatgcgcttctccttatgcgggaacggtgatgtggcggcgctgctcgatgttggtcgtcagcttccgtccgcggctgtggccgccgcactgcgtgcattgcagcagcaggtaggtgccgacctgagtgcgggctggtgccttctgcgggatcatttcgttgtgcccgcacttgttgcagcggtgctcgctgccgtcggccttgtagtacaccgcgatgttcgggtgcctgctgtaccagccacgcagcttacggtactcggccttcatggacttcacgtcgatgatgttgtacgcctcgcactcgtcccatgcaccgggcaggttctgcatgcaggccacccacaggtcgaagccggggaagttcgcatggtcgtacttgcgcagctcgggaacgatgacgccggtggtgtactccagcttctgcgaggtgaacgcgaactcgtcgcggttcagcagcatcgggtcgatcacgctgaccggggagagcggcgggaagccgaggatggcgaggcgagccttcaccttgcgcaggtcgaacttcttgccgttgcgagcgagaacgaagtccgccgcgttgagcagggcgtggagaaccttggcctgcttgcggtcgttgaacacgtccttctcgcggcgctggtccacgtagatcgtggcatcatcgtcgtccagccactccgcagcgaacgacatgagggaccagtcgcgcttgatctgcttcgggctgaagttgttgttgaacatctgccatccccaaaactcgatggggaaggtctcgatgtcgaggcacagaatcttcggcccctgcttcggggcgtgcttcaggaatgtggtgaggttcacgggttctccttcttcattgctcgggccttacgcgctttcgcattgcgagcgatacgcttctcgtcctcggtcttgtgggtgggatgcagatagcccgtgatgttggtcatgtgctttcgcaggtagttcgcaagccctccgcagaaggcgaggatgtcccgcactccataacgtgggccattgttctcgaccttgcccagcagcgagttgcacccacgatggagtacgcctcgcactgcgccagtacgatgatcgtgatccagcaccgggtcgagcggtgccttcagtccgagctgaccgccgcacagtgcgcagcggttgccctgttctgctgcgagcttgacccgcaccagctttacctgagctgctgtcagtcgcttcattgcttcaatgcctccagcgcagcgcgcttctcgttgacatcctcggcgaggtcgtagaacgcctgcttcagcttgtcgccgaacacgtccagctggagcacgtccagcagcgtggcgtcccggtccgtccgcatccacagcagcaccgcctgctcggcgaagtaccgctgccacccgtcacccttcacctcggcgtacttaccgtacaccagcggcgcggcttcggcgttgctcttggtgccggacagcagcgcttccgccgtggccttgccaaccctcggcaggccggggatgaagtccgccgtgtcgcccatgagcatctgcatccagaaccacttgtgcccatactgcaagccgtccgcacccacgatgtcgtaggtgccgagcggcacgtccacgatgtggtagtcctcccacgtgatgtgggtgccgcagaacattcgcatgtccttgtcggcggtgtggatcacatgcagcacgttaccgtgcttggctgctccggtgctgacgaaggccatgccgtcgtccgcctcgcgggtcgtccagattttcggtgtgaagtgcgggccgtcgtacgtctccatccactcgcggaggaaggcccagttgttcggcttgcgtcctgactggcgctgcccctgatacggctgagtcgtagcagcgaggaacctgtcacccttcgatgacgcgccatgtgtgaggtgcatgacgacacgatccgctccgctgatatgcttcaggtgcgagacgcgggagagcacgttgcgtcgtgcatcccccgctgaacagttctcgctaccagcgcagaagtacgcagcgtagtccccgtccacgtgagcgatcacgttgcggttgtgctgtcgtacttccacgatgggcatcggggagcgctccgcagccgcagccatcagagcgctcaggtccatcaggcgacgcctgccatcgggtcgtccatgtcgaacggcggcttgtcgtcctcgtcgccctgcgcgttgtccacgtcaccgaccgccgcgtccagcgcatccacgccttccttggtgacggtgccgccgaccagcttggaggccgcgtagtcgtagcacggtagccccttgaagttcagcgccttggcgatttccagctggatggtgttcttgctgcgcgcctcggcgatgaccttgccggtcttctcgtccttgcgctccgggtactcgccttcgatgtagatgctgtcccacatttcggcgtcggcgaagtcccacacgaacgccttcagctcggtcagcgccgcgcccaccgggaacacctgctccagcaggttgccggtcggctcaccgtcttccagctcggggacttggatgatcggcttgcggatggattccttgtcgatgttggcgtacgtcttcttcttgccttccgggccgcgctccacgtggaccacgttcagcagcaccggcttgcccagcagctggacgaagtgcttctcgtcggtgcgcaggcgggagaacatcttgaagtatgcggccttctccttggtcgagaggttgaggcgcaggctcaggcggaccggaatcttgacgccgccatccagttccttcggcggatgcttcttgccgatcagctcgaacacgatgatgacttcgttgttggtcttcttcttgccctcgaactcgctctcgtgttggcccacctcgtagtaggcgacgatgcgagcgccggtctgcccggcttcgggcggggtgtagtcgccgccaccggcggacgccacggactggtcctgacccttttcctgcacctgcttcagcagcttgtcgagactcatgctttggtttctccttattcaaacgacgggttgtgattaccgatgaagtccttgcggatttgcatgcggtactcggggaacaagacggcgaactcctcgggagggttgtgctcctccatcatgttgtcgcccatcttggtttcgcatggcacgccgagaggtagcggccacttgaaccaccactccatgtagacggaggcttcgagcatgcttgcatgcaggagcgctgccgcttccgtggcgatggatgctgcgctgtccacgtataccgcatcgtggacctgattcaccagcagggcttggccgagccagcgttccggttgggtgacgtacatgcggtagaaggcacgcagcgagacgtacatgctcgccttggcccactcgccgccagtcccctgcaccgggtagttcttgatttccgtgggcgagaacgactgcgccacgccgccacgtgaggcgggcttggttgcgatgaacttgggagacggggactcgctgaaggagtacatcttcccgtccggcgtggtgaagtgcgagcggcccagctgacaggtcaggcccggcacgtccgggtgctgcacgaaccggccagtcgtaacgcggttggccttgatgacctccatcatgtggtcgatgtactcgcccagctccgggtaacgctcggcctcggcgcgcaccagcttctccacttcctcctcggtcatgcccgtggtcgctgcgatcttcgcaacgcctgcgccgtacgcacgctggaaggagaagaccttcgcgttgcctcgcatcttcttccacttgctgtgctccgggtgggtctcgtccttcgctgccttcaggatgtaggcgtagtccttgccttcggccgcaccccatgcctgctctgcgcgcagaacgtgcatgtcgagaccggccttcaggtcttcgatcagctgtcggcactcggtgaggatcgcctgcacgtagatttccagcgacgtgaagtccgactggatgatcttgccaccagcgtggcggctgatgaacgcgcgcttgatctggctgcccttctccttgccggtctcctcgtcgtactcgcccttgctcacgttctgcaagttcgggtcgctcgacgacaagcggccggtcacggtgttggtcatgttgagcttgtggtggatgataccgtccggcccaaccagcgtgagcattcccttctgctccccggtcttctcgtccgtcgtgatgaagtacgtggacaagtccttgtggatgtcggcgcgcttggcgagcgccttcaggaacgggatgtcacgagcgcccagctcctcgatcacttccgctgcggtggagtacacgcccggatcggacttgctctcccagcgctcgctgccctcggtgtatccggggaacacgaacaccatgtcctcgttgcggaacttgggcttggtcaggtcatcgaccttgaccttcttggtcttgcgctcgcccttgttcttgccaccagcgaacaccgccacgtcggggaacttctcggcgatgccgtcgaaggcttgcagctcgttggcgttgtactcgccgatgctccgagtggtgccgtccaccaacacgtagtgcagctcgtccttctggacgtactgctgcttgccggtttcgggaaccagcacgggaaccttcgccacgtacttgatggggccgccgaagatcagcgcgctcttgtggaagcggctgttccagttgaaggtcaagccctcgggcagctcggggatgtaggactccagctctgcggtggcgtcggcaagctcctgctccagcttcttcgcatgctccagtgcccacggcttgtccacgaacatgccgttgtactcggcctcgatggtgaagcacagcgcgcccatgttgagcagcgccgagcgcaggccgttgcgtgcccggaaggcatcgagctgtccgaggaacatcttctcggtgttgccgatgtcgcccacgtcgtcggtgtcgttggtgccgacgaggtagtccatcagcagggtcttgtcgatgtcgcacgtgtccacccctgcattccacagggacttcaccgcgtcgtccttcaggttgccgccgtacctcggggccacctcgtccatcgcgcacatgtggaactcttgggtcatgccgtgcagcaggtactcggcaagctggcagtcccacaccatgccgccacggtcgatgaactcgatccatgccatgcgattctgcgggccttggcagatggcgtgcaggatgtcgaacttgatgttgaagccgacgaggtactgcgcaccgtagcacagctccttcagccaaccatccggcgcaccgccgacgtagttgttgtcctcgtcacgcccggtggtgaagtaccggccgctgttcttggcgtcgcccttgcgcttgtggccgatggcgacgatgcggttgaggttgtagaacggattcgccttgcgcttcagcgtggcgcggatcgtggtctccaagtcgaaggacacgtaactcatgcttcctccttcacggcgaagcggtgcgcatggcaccagaccttcttgccgcagtcgtcgatgacctgcacgtatgcgggccatgtgaagttgatgtcgtgcgcctcgggctggtagccctgcaccgtgtactccttgccggtggtgaacaggtagccacgcgagcctcgacacactacggtgtcgcctgctttcatggcgtcttgcctcccggcttggtgatccacacggtgacgcacgggatcaggttgatgcaccagcgcaggttgtgcttgctgtaatgcacgcccatccacatgctgcccttgttcaccagccatccccacttccatcgggcgacgggagcatcttctgcactcgccttgtagatggcctcggcctgatcgctgcggtgggtgtagacacgcacgccgttcggcaggtccacaaaccacaggcgcttctgttcgttccaacgaatcttcatgcttcctcctcgtagaagcgggcacgctctgcgtcgaacatcacctcggcacgaggatcacgcttaccgcctgcgcggtgcagcttgttcttcggcgtgccgatgtagcggaagcgatccattgcgggatcgttgagcttgccgcccatgatgatgaagtcgcacgcgccctgcttgcccgtcttgctgtccttgagtgcggactgcggcgggaactggacaccctcgccctcggcgctgatctgcgaagtcgccacgcccacggcgtcgtacttcacacaccagttgcgcgcggcttggtacatggcttcgagcatctgatcggtacgctgcccgccgttggtcatgccgccggtgaaggtgatgttgtcgatcatgtcgaagatgatgaagccggggttggtctgcttgatgatcgcctcgacctcgcctgaggtgaagccgtggatgtcgtagaactgcatgcggtggatgtcgccacccatcgcttcctcgatccgcttgcggatgctgccgtccttcgcccactccaccatttcggggatcgttgcgttgagcagggactgataccagcgctgcttgattcgcttgcccggcccctcgttgttgagccagattccggtgcgcttctggtcaggccacaccgtgtccagctgcgggagccagaacgtggactcgctggtcaggaaagtggtcttgcctgcatcggggcgcatggcgtagatgccgaagtcgccgccgcgcatcgggcgcaggttgcggctcaggctgggcagtcggaagtggattccgatgtcgccctcgtccatcgccatcagctcctcgggcgtctcctgcaccagaggcagccgggccttgcggtccatgcgttcggtgatgccctcggccagagcggacagctcgtcacgcagagagaactcagcgccgccattccactgcacgatcttgctgacggcggacgtggcaagctccagctccagcagcttttcgatcatgccctgctccgcctcgggcgggacagactcgcgcatcgcacgcagctgcaacttcagcagggacttcttgtcgtccggcagctgcttgaacttgaactccatcgcccaaccatcgaacacgtcgtgcggcagagccttggtctcggggaactccttgtagtacgcgcgcagtgcatccagcatcagcacggtcagctcgtccagcccttcgcgcggagcgttcgggaccagccggtcgaacttgcccttgtcgctgcacaatcgcagcagtgtcaagtctaatgacatagcttctcctcaatgtagtcggtcggataatacttcgggtcacgtggtgacgtgatgttccgatagtccaagccgaacgcacggaggcgcgcggcaatttgctttgcggcatcctgaccgggattgctcccgtccgatctgcccttgtcgtcgtcgagccacgtcgctacacgttggcctcgctcaatcagctgcatcaacaccttgttgtgcagcttggtgccgagcaacgaccacgcttctgttaccagtcccaccttgtatgcggagagcgggtcttcgcatagaacgatggtgtctcccttgcccacgccgaagcgtgcgacgagtccgtctttcgggacatcaggagtcagccacttcggttgcctcgtagaggaccgggctgtccagtacacagggcggtcgccttccatgatgggtagtaccacgcgcccgatgtccgggcaccagtacaggccgagttccccgatcatgcgaagcgagaggcccatcttgtagaaccacaccttgtcacgcagcggccactcggttgtgtcatagacacgtggctctggcaactcaacagttgcgcgcactctgcgctcgctggtttgctcggcatgggttcgtactagcttggcttctaagctctcgtgctcacgcttgaatcctgtgccaccgcacctgaaacagtatgcggtggacttgtcgtgcgagcgagtgatgagcaacgagtttccctcaccacacgcatggttgatccgagtgcgggtgccgaccttcagtcgttccgcatgcggcagccagtcgctgtcaggtagttcgttgctcatcttgtcctcgctaggtcagtggctccagatcgaacccggagttgcgaaggcgacctcgccgttgctggtgttgaccagctgacggttgcccttcttgtcgttgacgttggtgacgagcaagtaggtgtcgccgtccaccacggtgccatcaccggtggcgatgcagcggtagttgtagccgaccttcaggtcacgcccggcgacgaacgccgtgcggctgggtgcggtgctcggggcggaagcgttcattcggcaccgccttcgccgcccgctgcggccgccgccttggctgcgtcgatgtcggcctgcgccttctcgatgtcctcgctggtgaacagcagggcggtggcgtcgatcaggtggaactcggcgtcgaagccctcgccgtgctcgaccttcagctgcacgacacccttctcgttcttcttggtggccgacacggtgccggacaggacgcgcttgttcaaggcacgaccgtagacgtaggccacggcgtcgcctgccttcagcgcttcgatggcggcctcgttggcgatgctcgcttcgatggcggcgatcttctcgtcgatcttgctcaccttctccagcgccttggcccggtcttcgcgcagctcgttcagcttgacttcggcgtgcgagaactgggtctgctgggcggtgttggtatcgttcgacatgtggtgtatctcctttcattgacgggttgatgggtggtccgtaacgtggtcccttccggcacgcaatcagtgcgagatttactggaagatcagctcgctgttgtacccgccgccgccattgtagaagcgacgacgcagcacgctctcctcgccgagcaccagcaggcggtccacgatggcgcggatggcgcccatgtactggtccaccagctcgctctgcaagttcatgtcgaagcggatcacggtcaccgcctcgtcatccagtgcgccggtatccttgcggacgtacaggccacgggcattggtcatcgtcgcaccgccgatcagcttgacggcggcggcaatctccggctgcacgttgagcagtcggctgtcaggcacggtcacctcgacccagcttcccatgcgcaggctcatgctgcacctgccagtgcggcctgcacgttcggctgcaacgatgcaccggcacgcagctcggctgcccggcgcttgatcttggtgcggaggcggcggcgttccttgttgttcgcgcccatcgcatcggccgctgccttcatcgcgttgttgcccacgttgcgggtctggcccggcccgcacatgtagtcccggcccagcatcttgcgcagcagcgggttctcgatgggaatcagcggcaccgagacgtgcaggtagcgggaggtgtccggcgcaggaggcggcgtgttgtcgtcatcgtgctgcggcttgatggcgttgaccaccttgtccttgatgtacttggcggcgctcttgatcttgtcgaggaaacccatcagcgtttctccttgttgtggaagtggttgaactccagctcatgccacacgtagtacgtggtgccgagcgggtcggtcattgcctgctcgttgcgcagcgtgcagtagtcgttggcctcgtcgaggttgtcgtaggtgcggacccacaacccatcgggagttgcctcgccggtgcggaaccggcacagcctaccgtcatcgtcatggtactggccgacgacgatccacggaccacgcccgacgacccagtagagcaggatcaggaggcgcaggccgagcttacgcatcggcgtagaccgcttcgatgaagtagcccgacgggttgcccttgctgcgcttgtcgccgagggtgtccagcacttcgcgggcggcggcacgggtcgggaacagcaggttgctctcgtcgttgttctcctcgtcgccgtcgatgcggacggtcgcgccgtcctcgacggagttgtagcagctgatgtagtcgccgtcgtacttgatgcgccaacccagcacgggctgcacgctgcgcaccttgtcgccgaactcgccgacgccgtagtcgaagtgcggggactcgaaggattccagctcgccgatggcagcacgggcggcggcgcgcttgtcccagaccaccacggttttcgggtaggtgccgtcacgcagtgcatccgacaggctatcggtcgcgccaggcttgatggtggacaggatttcctgcacttcctcggtggtggccgggcgggcaccggtcaggttcgggttggcgacgacgccgacgatggtgttggtgcccttggcacgggtgatgccgaagtaggtcttgctcatggttgattctcctcattgacgggtgggatttcgtactcctcgacatcagcgatgcggtcgtttgtcttgaccagcgccgcccatgcctcggcctcttctcgatcctcgaacgtccatccattgggtgcgccgaggtgctgaccgctgtaccactgcgcgcctgtcttcaggctcgtcatgtggacgcggtaa

SEQ ID NO: 20 - DNA, 44521 bp, Unknown
  Bacteriophage Xfas302
cggcaagtggtaagccaccggaacagcggaacggttagcaccttgcggactaccggcatacatggtaggatggtggcgacaggacgcccaacgggttagagactcgaatcgagccaaggggcttgacaggaagcaaacagggtgctagtatggcaccacgctctgaggagcaccggcactggaccgggcaggactaccgctaacgggtagggtgtaacgggaagccttataggtggaccgccaagctgcaacgtagcactagcggataaccggatgaactgggatataaaaggcccatagaatccaccagactagcaacactggtgccgctttacctaagcctaacgcttagggcttcccatctgccgtgagagtcggccacgggaagtaacccactgccaaggtgggaagccggtcataagcgggtggtgagcctgctatggtagggcataccctatctttcgtgaaagcttcgggatcggccacggtgacaatggcactgctagccggagtagggttgacagcccgaagggctagcagattgatgcacactcacgttacagctaacttcccacctgacgccgcaaggtattggattgccgagggagacgactagggttgcgggtagtccctgattagctgcatcgttcgcttctatcacggcacacattcgagtgtgatagctctttgtggagtgtgcatcaatctgttagttttcccaccagtgccaatggaggcacaccatgcaaggctcgaccaatgccaatctggaacgcacccgcaccaagcgccgcttttgccaattcacccggactgcaagcgtgatggacctgcggactaccgagcatgaccgcaagctcgccgagcgtaagcgccaagccgaacgatacgaagcccgccacggaaccgctggaaagcgatctgtgtttgctgtcgagggcaacagcgggaccaatcgggcgaaccacgccgctgatcggagggcctacctgtgatccgtttctacttcgccgcagggtacagcaaggccgcgtgggaaagccaccagcgcgcattggtcgctcactcggcgacacccgccgccgtctccgacctgcgatggaccggcgcacgctggacctacgacatcaccctcgccgcacctgcgatccactgaatgcaagctactgggccttcgcaagagggcctagtgtcgtgcaatcggcacggacccaacctaaagggaaccaccatggacatcatcaccggaagcgctgacatcaagcgcgccatcaagtcgatcaataccgctcgcaccaagctggtcgatcagattcagcaggccgccatcgcggtcatcaaccacgcacacatccacggcgacgttacgctcgcttccgatctgtgtctcgccgtgggcaacggcatgaagcatgaagccctgcgcctgtacctgtccgagttcggcccgatggctccgaacgacgacaaggaaaccaaggcgagcgcgcccatgaagttcgccaagagcaagcgcgtcgagggcgaagctctggccgacgtgctggaacgtgccgccgcgaaggcgtggttcgacttcaagaccgagaagcccgccgaggcgttctcgttcgccgccgacctgcacaagctgctgggccgtctggaaaaggcaaccgaggagggctacgtgccgaccgaggaggagcaggccgtcatcaacgctgcccgcgccgtcccgaagcctgccaagaaggtgaaggcgtaatgcggcccggcacccgcgtcatcggagccggtgtgcgtgggtgccgctgtctgaccgagggcaaggaatacacggtcgaggactaccagcccgcctataccgacccgacaagcgcgagcggtttcacgtggcctgcctacgtgggagtcatcaacgacgatggccgactcgcctactaccacacccaccgattcaaggagaaagccgatggaacccaagatcaacctgcgcgtaacccagcgtgaggcgtcgttgctacgctcggccctgcacattgcctgtgcgctgactgccaaggccgacccgtattccaaccgcaagctgtccaacgagttcgccgtgctgcatggtgagctgcgcgacttcggtgtcgagagcttcgagcgtgataccatcctgaagttcgaggacgacgtgattgcagcctgccgggacagcgatgtcgaggcgcagctgctgcgcgacctgttcgctcgccctctgactgtcggctacggcatgcgtgagatggactacgccgctatcgaggcccgcgtgatggcctgcctgctcgatccgatcccgccgctggtgatcgacgcatcgcagctgccgttcgagttcgtgggcaccgtgaccggccgcagcgtgatgtccggcccgtccatgccggacaacctgccgcgcaagctgcccgacgtgctgatggacgaccagagcgcacgacacgtggcgctgaccgcatcacagaccgggctggtgaacaaggccgagccgaagggctggatcgtgcagttcaatctgcgccatggcagcatcgccctcgccaactgggcgcaggtgcgtgagctgggtctgccgcagcgcagccgcaatgcagcgtaccgtgcactgaaggcgcgggccaaggcgcagggcatcgccgaggacgcctaccgtgtggtgcctgccggtactcccgatggcccggagaaggatcgcggcttctacaccgccgagttcttcaccaagcatgccctgcgtccgcatcagcttggctggaatacgtccggcgcacgtggtctgacaggcactttcccgactgcgcaggccgcagccaacgccatcgaccagcacgtaaaggacaccggcgcatcccgcagccgctatcgtgtgaagtggcacaagaaccgcgcgtgatctaccgctgcgccttctaacgagggcgtagctttggaaccacgcccaacaggagggcacattgcatgatccccgtaacttacaagcgcatccgtagtgggaagcgcaagccgatccagctgtgcgagaagccgcgccagtggaaggagttcgtgacccatgagcacagcgtggagcgctggtatgcgtgaggtcagcctgcgcctagtggtgaaggcgctgcctctcgttaccgtgaagggtgtagctgtcggggattacatcctcggcggccaccacaccagccacgaagcgtgcgagcaagccatcgcacaccaccgcaagcaccacgagaaggtgcccaccctctacaccgtagaggaaatcgaaatcccacccgtcaatgaggagaaccaccatgcgtaagctgtacttcatcgcttcgatcccggccaccgcgaaggatggcgtcatcactggcgtcgtcgccaatggcactggccgcaatgccaacgccgaggaagtgaccgcgctgatcgacctgctccgcaccaagggcgcaactccgtccctgctggacagcctgcgcgatgccacctatcccggtccggtgtctgccttcgagcgccgtgctgctgcccgtgccgaggccgacatcctgaactccttcaatggtggtggcctgttcaactggcacgtcatcgaagtgggcgacagcatccgcaagccggtgcgcaagccgctgggttggcgcatcatgtacgacacggactacaccagctgctacaacagcatcgaagacggcgcgaccgtgcgcatcgacggcgacgaggggaaccgtagcgaagacaacctgctgttcccgacccgtagtgcggcgcgcgatacgctggacaccatcaacgacaagcgcagcaagcagaacccgcagggctacttcatcgtcccggtgtacgccgatgcgtaagctcggcctgcgactgctgatcctgctgtactgggtgatcggtcgtggcccttgggttgtcgtgggccagtaccacgacgacgagggcaggatgtgccggttccgtaccggcaacgtctccaacgacggttactgggcgcgcacgttcgatgacctcgacgaggccaacgactactgcgacacccgcaacgagcaggcacacaccgatccgctcggcaccacgtactacgtgtggcacgagttggagttcaataacttcggaacgaggaggaagtaaaccatgggcttcatggacaagatcaaggcagctgccaagtacgtcaaggacaaggtggtcgcagcggtgaagccgcgtcacgacgatgacgatacgccgccgcccgccccggacacgagccggtacctgcacgtcagcaccccactgattcccatcgacaacccggtgctgcgcaagatgctggggcaggactacttccccgtgcagaaggggcagggtcagacccgcatcgtcggcaacaaccagctgaagcgcgtggccgatagcctcggcggcaacaacaaggaacgccgcaagctgcgctcccgcatgaagcgccgtgctgccgagctgcgtgccggtgcatcgttgcagccgaacgtgcaggccgcactggcaggtgccgcatgagcctgcgcatgggaagctgggtcgaggtgaccgtgcccgatagccgactgctcaacgtgcagccggagattgccgccgccgtgaagcttatcggcggtgcgaccatgaccaatggccgtggcctgtacgtccgcaaggacaccggcgcactggatgacgaggcggtgaccgtgatccgcttcgacctgaacttgcagagcgagctggtggaccagtacatgagcgcgatccgcgcaatcgtggaccgcctgctggtgctcggcgaggagagcgtgctgcgccgtcgcttctacagcatgggcggcgggtacaacagcgagctgatcttccagtaagaggaggcgcgatgcgtatcagggacggcccgacgtaacgcccaccaattattgaggatcgttgggagcgcccgcctcccttgattaacgggcaccatcactacatcaaccgtcaagaggaaccatctacatgtcgaacgaaaacaccaccgagcagaccaccatcagccactacgaagccaagcgcgccgagctgctggaagacatcgccaaggcgcaggccaaggtcgatggcctgaacgagaagctcgccaagctggatgccgtcgaagccaacagcgccgccatcgaagcgctgtccgctggtgacgccgtgtcctacgtcttcggccgtgctctgaacaagcgtgtgctgtcgggcgtcgtggtcgccaccggcaagaacgacaagggcgtgctgcaactgaaggtgcagaccggcgaaggtctggatgccgagctgaacctgatcgacagcagcgccctgctgatgtcggccgaggaagtgctgaaggcgcaggaagaaatcgacaaggccatcgccgaagcgcaggctgctgccgctgccaaggcgcagggcgaaggcggtcagtcgtgagccggggcagcaccagcccggcggtgccgccgaccagcgcgccgagccgcagccagttcaccgcaggccgtgacctgaaggtcggcttcaactaccgggccatcagctccggtgctggtgaagtgatcgacggcgacacctacctgctggtcaccaacgtgaccgacaagaagggcaatcgtcagctggtcaacaccagcaccggcgaggtgtccttcgccacgcccggctccatctggagctactgatccgacgaggatagcatgagcgatacccttcccgacaacgactggctaccacacgccgagcgcctgcctgttggtggccgcacccgagtggcccatgagtgcggggagggtacgcccttgctgattactcgtgagcatgacaagtccaccgcattctgtttcaggtgcggtggcacaggattcaagcgtgagcacgagagtatcgaggccaagcttgcgagaatccacgccgagcaaacgagcgagcgcagagtgcgcgcaactgttgagttgccagagccacgggtatacgacacccgcgagtggccgctcgacgctaaggtgtggttcttcaagatgggactctcgcttcagatgatcgagaagctgcggctgtactggtgcccaagcatcgggcgggtggtactaccgatcactgaaggcgacaacgtggtatactggacagcccggtcggcaacgagacagccgaagtggctaacacctgacgttccgaaagacggacttgtcgcacgctacggcgtgggcacaggtgacaccatcgtactgtgcgaagacccgctcagcgcatacaaggtgggactggtaaccgaagcgtggtcgttgctcggcacgaagctgcacaacaaagtgttgaagcagctgactgatcgaggccaacgtgtagcgacgtggctcgatgacgacagaggtagaagcaacggtagcaatcccggccaagacagcgcgcgagtaatcgctgcgcgtctacgtgcgtttggtctggactacaggaacatcacgtcaccacgtgacccgaagtattacacgaccgactacatcaaggagaagctgcaatgagcaaacccatcgtgcgctaccggcgcgctatcatcccgcctgtcgttggcttccgtgccacgctcggcggcgtgcttgcgcatccgaacctcggcgactgcgacatcgtgcacacctcgacggtgctgtacgtgacagacggcgggcgcaagttcgagacacgcaacacccggtatcaccagctcgattcaaagtacgaacccgaaggagaacctgatgagtcttgacaccacgctgctgcggttgtgcaccaaccgtggcaagttcgaccggctggtacccagcgcaccacgtgatgggctggacgagctgaccgtgctgatgctcgatgcgttgcgtgcgtactacaaggagttcccggacacgaaggacttgccgttcgatgtgttcgatggctgggccatggagttcaagtggaagacgcagcccgacgacaagaagtccctgctgaaagttctgctgaagcagatgcgcgagccggtcccgcccgaggcagagcagggcatgatcgagaagctgttggagttggagcttgccaccactgcggtcagcaagatcgtgcagtggaatggtggcgctgagttcagcctgcgcgacgagcttgccgggttggctgagacgatcaccgaccgcatggatcgcaaggcccgcctgccgctggtgcaggagacgcccgaggaactgatgcagatggacgagcacgacatcggcatccacttccgactgcccacgttggcccgcaacctgcgcgccctgcgtggtggtgacttcggcatctacgccatgcgtcccgacgcaggcaagaccacgttcctgaccagcgagtccagccactggatcacgcagctcgacaacgtgtggcccgaccagaagcgcaccggtatctggctcaacaacgaaggtccgggcaagcgcatcaagcagcggtggtatcagtcgttgctcggtgctaccatccccgagatggtggagtgggcgaaggactggagcatccgcaagcggatcgaggatgcaatgggtggtgacctccaccgcatgcagttctacgacatccacggattcaactccggcgaagtcgaagccatcatcaagcagaccaaccccggcttcatcatcttcgacatgatcgacaacatcacgttcaccggaggcatgaccaacggcggacagcgtaccgatcagatgctcgaagcgatgtaccaagccgcccgtaactggtgcgtcaagtacgacgcagtgggcgtggcgacatcgcagatcagcgccgagggtgagggcatccagtacccgccgcagtccgcactgaaggacagcaagacgggtaagcagggtgcgtgcgacttcatcatcatgggcggcaagctcaacgacccggcgatggaacgcttccgctacatcggcacaccgaagaacaagctgcaccgcgcaggcggtaagcgtgacgttcgtgaggaggtgatgatggatgccgagcgcgcccgcttctatcaggaggcagcatgagtcagacgaaagtggaagtgcacgggcaccgtgtgttcttgcccggcatccagaaaggattcgacacggtgtccagcagtcaggccaactacctcgcgtccgtcgtgagggatgcggtcaacgctgcatacatcgaaggacgcaacgatgctccgcagtggaagtggggatggttgcgcaacaagcacagcacatggatcggcgtgcactactcgccgcacaacaagcgctggtgcatcaacctgatcccatgcttcacgctgtggatcaccaagcccggaggtaacacaccgtgagtaccgaaccgaacatctacctgccgcgcaacgtgggcgtaatcacgtccagccgcaccggcagcagctacaccgtcgagcctgccgtgaccgacacggacatcgacttcctcgtgctggttcaggatttccacgaggccatcgccaagctggtcgagcagggctggaccttgtgctctggtgctgacgggcactacgaggaagacgaggactacagcgacacgtggtacgctctgcgcaacggcgtgttcaatgtcatggtgactgccgacagtggctggtataagcgcgcggtcgaggccaccaccatctgcaagcgccgcaacatcaaggacaaacaggaccgcatcatcgtgttccggtgggtgcgcgatgggctggacttggatggcgatgcgtcggatgaaatgtaccagcttgccctgcaacggtggccgctgtgagcttcacttccttcgacctcgaaaccacgatccgttccatcctgaagcgcaaggccaatccgttctacgacatgaacaagatcgtggcgattggctacaagcgcaagggtgacgcacggaacaccggcctgtactacgacacccgcatcggcatcgacaaccagtacatgggcggcgcacctgacgggtggctgcgcgagctgtgttacgggcagcagttcctcgtcgggttcaacatcaagttcgacatcctgcacgccatctgccaaggcccgctcaatcggcaggcatggatcgagttcatcgacggcggcggcatggtgtgggattgccagcttgccgagtacctgctgcacggcatgacgcaagagttccacatggcgagcatggacgagacggctccccgttacggcggcaacctgaaggacgatgcagtcaagtccctgtgggctgcgggagtggacacctgcgacatcgacaagacgctgctgatggattacctcctcggcaccaacgacaccgacgacgtgggcgacatcggcaacaccgagaagatgttcctcgggcagctcgccgccttccgtgcacgtggtggtctgcgctcggcgctgctcaacatgggcgcgctgtgcttcaccatcgaagccgagtacaacggcatgtacgtggacaaggaatgggcgcttgcgaaggcgaaggagttggaggtcgagcttgcaacagcgacggctgaactcaacggcttcatccccgagttgcccgagggcctgaccttcaactggaacagccgcttccacaagagcgcgctgatcttcggtggcaaggtgaagtacacggccaaggttccgatcatgtccaccgagggtgggccgacctacgtacagaaggacgaggtgcactatgtgctggtcgatggtacaacgacggcgacgccaccggccgaggacttcgacaacctgtggcggtacaccacctacggcagcggcaagaacaagggcgagtacaagaccaagaaggtgaaggtcgatgacttgaccaagcagaagttccgcaacgaggacatgctgttcgagttccccggctacaccgagccggatgctgcgtgggaaagcaagagcgatccgggtgtgtactccaccgccgccgatgtgatcgaggcgctgggctatcgcaacctgccgttcaccaacgcactggcccgccgcgccgacatccacaaggacttgtccacgtactacatcacgacggacgagaagaccggcgagcagaagggcatgctcacgctggtgggaccggatggtatcatccaccacaagctcaacatgaccaacacggtgacgggtcgcctgtcatccagcgatcccaacttgcagaacgtgagcaagggtgagctggacgaggagacgttggaggagaagggttctcagatcaagcgcgccttcgtgtcccggcacaagggtggcaagatcatccagtcggactacacctccctcgaaatctacgtgcaggctatcctcaccgagtgccgtcagctgatcgaagacctgaaggcgggcctcgacatgcactgcctccgtgccgagcaggcgtggggcgagcagggcaagtacgactacgacttcatcctgaaggcgagcaaggacgacaagcatcccgagcacaagaagtggaagaagaagcgcggcaacgcgaaggtgttctccttccagcgtgcatacggtgcaggcgtggcgaagatcgctgcgaccaccggcatgacggaggaggaagtcgaggcgctggtgcgcggcgaggccgagcggtacccggaactgggtgcttacatcgaccgcatggtcgaggccatcaagcgcaaccgcgtcagcaccaaccgcttcgttccgcaccccgacgccggacggcagggcgtgcctgctgggctgacgtgtcagctgggccggtcgcactggaccacgccggacggcaagatgtattccttcagcgagtcaccgtccccggtgttcatcgccaacaagcccgcgagcaagggcggctgcgcgcagtcgttctcgcccacggaaatcaagaactacccgatgcagggcaccggtggtgagtgggccaaggcggcgatgtacgtcagcctgcgcgccttctaccggaagtacgtgaccgaaccgaaggagtggttgggccgtgcgttgctcgtcaatcaggtgcacgatgccgtctacgtggatgcacatggcgacatcgcaaccaaggccgctgctctgctgcacgcctcgatgctggaagcgtcggtgtatatggagtggtggttcaactggacgctgccgcttggcgtcccgtgcgaaaccaagatgggcgacaacatgatggaggagaagaatcctcccgcagagttcgccggtctggtcatcgagtaccgagcgtcgatccgcaaggacttcgtaggtaatcacaacccgtcgtttgaataaggagaacaacacgcatgagtcttgacgcactgttgaacaaggtcgccacgcagggtaaggaccagtcggtcgccagtggtggcaacttcgactacaccccgcccgctgccggtgtgaccaccgcccgcatcgtcgggtactacgagctgggcaagcacgagttcgagttcgagggcaagaagaagacgcaggatgaagtcgccatcgtgttcgagctgaccggcaagcagcacccgcacatcgagacggacaatggtccggtcccggtgcgcatgacgctgacgctgggcctgtccaccaacgagaaggcgcactacttcaaaatcttcagccgcctgcgcaccgaggagcgccacttcgtgcagctgctgggtcagggtgtgctgctggaagtcatccacaagccgggcaagcgcgacccgaacaagaccttcgccgagatcgacaaggcttccatccgcaagccgatcatgccggtgccggaaatggagaacggcatcccgaccggcaagttcgtggacaccgtgatcccggtcccgcagcagatcaccccgctgggtgcgttcgtgtgggacttcgccgatgccgaaatgtgggacagcatcttcatccccggcgagtacccggagcgcaaggacgagaagaccggcaaggtcacccacgaggcgcagtcgaagaacaagacgcagctgcgcatcgctgcggcgctgaacttcaagggcctgccgtgctacgactacgccgctgccaagttggcgggcagcaccacggtcaccaaggaaggcgtcgatgcgctggacgaagtggtcggcgacgtggcgaacgctgcgcccaccgacgctgctccggccgacgacaagccgccgttcccggtggacggtagcgacccgatggcaggcatcgcctgatggacctgagcgctctcatggctgcggctggtgagcgctccccgatgccggtacaagtggtacgtcaacacaatccccgcgtgatcgctcacgtggatggggactacatggcgtacttcgcggctggtagcgagaactgctcggcgggggatgcacggcgcaacgtgctctcccgctgcgcacagctgaagcatatcagcggagcgggtaagatcgtcatgcacctgacgcacggcgcatccaccaagggtgaccgcttcctcgctgctaccacgcagccgtatcagggtcagcgccaagcaggccgcaagcccaacaactgggcgttccttcgtgagtggatggagacatacgagggcgacgctttcactcccaaaatctggctgacgcgagaagccgacgacggcatcgcatacgtcaacgagggtgcagcattgcaccacaacatcctgcacgtggtgcacagcgccgacaaggacatgcgaatgttctgcggcgtgcatgtagactgggaaggctacggcatcaccgaggttccgctcggcgcttacgacatcgtgggcgagaacgggttgcagtacggtcacaagtggttctggatgcagatgctccacggcgacaccgccgacaacatccccggtctgccgaaggtaggcaaggtgacagcggagcagctgcttctcgacacgaaggacaacctcgaagcggtgcagctagtgagcggcaagtacagcgaagtgctcggtgccgactggcgcaagacctttgccgaacaggccgtgttgctgtggatgcggacggatcgtgacgctgaactgctggacgtgctgaagctcgacgtgttcgggccgcagctgaagcaagcattctacgacctcgccgaggacgtgaacgagaagcgcgcaatcttggaggcatacaaagcatgaagcgactcactgcaacgcaggtcaagctgttgcgcatcaagctcgcagcggagcaagggaaccgatgctgcctctgtcagggacagttcggcctgaaggctccgctcgatcctgtgctggaccacgaccacaagaccggcgctgtgcgcggggtgctccatcgcggatgcaactccctgctcggcaaggtcgagaacaacgcaggccggtatggcgtgcgcgatgtgttcgcattctgtgcgggcatccccaactacctgcggtcccacctcaccaacatcacggggtacctgcatcctacctacaagaccgacgacgagaagcgcatcgctcgcaatgcgaaggcgcgtaagcggcggtcactcaacaaggagacaccgtgacccttacccagttcattcgccgagcaccgaagcgcggcccgaagattctctgcctcgacatcgagacgttccccatcgagttctacggctgggggatgttcaacaacaacttcagcgtcaagcagatcaagcgtgactggtcgctgatgtcgttcgcttgcgagtggctggacgatgacgagtcgttctatatggaccagcgcaacgtgcgtgatgtcttcgatgaccgcaagcagggcaaggcactgtggcacctgctcaacgccgccgacttcgtgctagctcgcaacggcaagaagttcgacctgcgcaagatcaaggcgcgcctcgccatcctcggcctgccgcccgtgtcgcccgtgcaggtgatcgacccgatgctgctgaaccgcaccgagttcgccttcacctcgcagaagttggagtacaccaccggcgtgatcgtgccggagctgcgcaagtacgaccaccacaacttccccggcttcgacctgtgggtggcctgcatgcagaacctgcccggtgcgtgggacgagtgcgaagcgtacaaccgcatcgacgtgaagtccatgaagttggagtacaagaagctgcgcggttggtactcgcagcatccgaacgtcgccgtgtactacaaggccgatggcagcgagcaccgctgcaacaagtgcggctgcaacgaaatgatcccgcaggatgatccggcccgcacacaggtcggcacgtacctcctgcttcagtgcaccgtgtgcgacggctacagtcgtgggcgtaagctgacgaccagcgccgaggcccgcaagcacatcaccgttccggcataaggagccgacatgaagatcaccgacatccgcagcggcatgcgggtacagtacaccggaaatgcgcccggcctgatcgggcggcgcgggaaggtaagccgcgtgttcgctaaggatgtcgaggtcttcttcgacggacgtgtgagcgcgagctactgcgttcccgattccctccgacagcttatgagcatcggaggtgtgaccaccaccagacgagaggtacccatgcccgaactgaactaccgcaacgaggacgagcgcacgctgtccgaccgtggcgtcggcctgaaagatgacggcggcaagccgcaggctcggctgctgcatgagggcgtgcctcgtgcactggcccgcgtcatcgacaccttgaccttcggggcgcagaagtacaaggcgcactcgtggcagcatgtcgagaaggcgctcgaacgctatcaggatgcgagctaccggcacgacaacaagcgctgcctcggcgagaagctggacccggagacgggcatccatcaccgcgcgcaccacatcatcaacgagctgttcctgttggagttggaactgcgcgaggaggagcaggcccgtggcgcagagtaagggtcgctcgatcaaggaggcgtgggtcaacatcgccatcgggtacagcatcaactactgcgcgaacatcgcgttgctgccgctgctgtggcatcccgaacacccgcttatgtcggcccacgccatcggcgtagccttcacgcttatcagcttcgtgcgccagtacatcatccgccgctggttcagcaagggtgactgatggcctgcgcccgctgcggccaagtgcaccggtacgtcccacatgaggccgagtgggcgcgcttcctagaggagcatcgtacccgcaagcagttcgatgtcgagtgggccaactcactctggcatcgcacataccctgacgacgccttctgcattcttgtgatgaagggccgcgcaggtttcgttccattcccgtcgaaggagaaatgaatgctctacaagaaccagaccgccatgcttatcaagtcctacgagaacaccgtggcgtggggcgagagtgccgaccacgaggaggcgttgcagaacgcggtcaaggcgggcttcccgaacctgccggaagaagatcaggccgagctgtatacccgcatcgccgatgcgtgggaaggctaccgtggttcgctcgctccgcgcaagctgtggatcggcaccatcgtcaaccagttcatgtcgtcccgcatcgcacggttcaacgccgcactgggcgatggcagcaagaaggaggacagcgccgatgtttgacatcaagcgagataacgtgcgggtcgctcccggctacaagaagcgcaagcgcggcttcaagatcaaccgcgccttcaccaagggcaacttccgggtgacgtggtacgacggcaaggccacctactgggagcagtacgtgccgtggtacaaggtgccgctcgccatgttccagatttggagggaccacgcatgagctacatcgtccacaaggcagtcgagcaggacaagatcaagaagaagctgcgtcccaccgaggagcagctgcgcaccgagtacatcgcacagcccaagtacgacggctgcaacatggtcgccatcaagcgcggccactgggtgcccaccgtgaacaagggcctgcacgccatcaaggtcggcgacgtgcagatgcagcccgtggatcgcggcgtggtggacctgttctcccgcaccggcgagcaggtggtcagcgcgcaccacatcgagaacgctctcgcttccgcaccgttcttcccggtcggtgtctacttcggcgaatactggcacccgaccatcgaccagcccaccgtcagcggcatgttccgcaagaaggacggcacgcagtacaccgagccgatgttcgtggtgttcgactacgtgacgctggaagaatgggagcagggatacagcgacctcgtgtatcaggagcgcgtcagccgcctgccgagcatgggccacgccatcgccgagggtaccgctcccgtgttctacgccgagtcgcagggcttcctgatcgaccaagagctgggcagcatggaggcggcgaagctgctgtgcgagggtggagcatacgatggcctgatcctgcgcaagccgagcggcaagtgggtgaagggcgacaagggcacgaacggcgaagtcgtcaaggtaaagcccacaatcacgctggacctccgcgtcgaggacatcggcgtcgaggttggagagaagaccggccgcaacgtctacaccctgtgggtccgactgccgaacggcaaggcgcaggaggtgggaagcggcgtgccgcaccatggcaacggtgttccgaaggtcggcgacatcgtggaaatcgaggcgatgtcgtacagcaagttcggtctgctgcgcgagccgcgcttcaagggaatccgctacgacaagccggaggctgaccaatgagcaacgtcaagaccgaggtgtggcacaacatggaacgcgacacagtggaggtgcgagtgagcatcccgttccgcgagtacgccggttccttgtggccgaacgagacggtgcgcgatgcggtgatcgaatcgctggatcgcttcctcgccgagcggaggggctgatggacattcgattcggaaagcccgagctggatttcggcggtgatcgcttcgctccctacggtggaggtcatgtaaccgtgactgccactgcgtggtgcggcaccgagcagttcttcaaccgtcagtgcatcccgagctacgaggtcggcggcgacgcatggccgcacatcatcaacgaaatgcacaccgcactggtctgcatgatcctgaagcgttacccgccgacggacttcaccatcaagcaacggaggtagcatgctctcgcaagtggaactcgaactggaaacctacgccttcggtaaggagcgcatggagaagtccatcgcccgcaacgaggagaagggcggcgcggacaacaacccctacgcccaagcagtgtatcgccggttcgtgcttccgcttgcggagcgcatccgtgcggacatcgactccccgcgcatcggccgcgcccaagcgcacgtgccacttctgcgcgccaagtacgatcccgagcgtcagaacaagagtggacaggccatcagcgccgaggaacaggcccgcgagtggtacgaggctgtggccttcgtcgccgttcgcggtgcccttacctcttgcatgcgtgacaagcacggcgaaggcagcgaccgcgacgtgctgaagaacgtcggcatcaacgtgtaccacgagtacctgctgacgcagttcgccgacgcagagccgacgctgttctaccacctgatgaacgacatggaccgcaagctctctgtcaacgagaaccaccgcatgacggtgatgaagatgcagggtcgcaagaacggcatcgagttcgtggagtgggggcaggcgcagcgcgatcaggtcggcgcgtacctgtgcgaccagcttgcacagctgggcatgttggagattggcgtagtcaccgagactgcggccagtgccggtgcagcgtaccggaagttccagaccaagacgcacgtcaagatcgtgctgaccgacgaggtgcgcaagctgattacgcagatcagcgacttcgtgatcgaggccacgccgttctacctgccgtgcgttgagccgccgatggactgggtggacatcgacaacggtggattccacacgaaggaaatgcggcggctcaatccgtggatggtgaagacctacgctcagacgcgcgacgagtaccgcgccgccgagctgcgcaacgagatggctgcgatcaacgcattgcagcgcgttccgtggcgcatcaacaagcgactgatggaagctgtgtcggccatcgccaaggtgcacgacatggaggaaatcatttcgcagggcgagctgccgaagccgcgaaagccggagtggttgaccaaggacatgaccaaggaaaccatgtcccacaatcaggagttggagttcaagcagtggaagcgcgacatggcgaactggcacaccgacgagcgcctgcgccagaacaagggcaatcgcttctacaacgcaatgaaggtggcgcgtaagttcgctgagtacccgagcatctacttcgtgtacttcgcagacttccgtggccgcaagtacgttcagaccaccggcgtgtcgccgcagggttcggacttgcagaaggcactcttggagttcgccgaaggcaagcccttgctgacgaaggacgcgcaggattggttctgcatcacgggagcaaaccgatggggttacgacaaggcgtcgttgccagaccgagtgaagtgggtgcgcgagcatcacgaccagatcatggccttcgctgcggacccggtgaacaacgacgagtggaagacggccgacaagccgttgcagtttctgagctggtgcatggagtacgagcagtggcaagtgttcggggatcgcttcctgagccgcatcgcagtcgggatggatggttcgtgcaatgggcttcagaacttctcggcgatgctgcgcgacgcagcaggcggggtggcgacgaacttgatcccggcaccgctgccgaatgacatctaccagatggtcgcagaccgcgtgactgcgatcctgctgggcgaggaggaagacgccgaagggtaccgcacgctgtggctcaaccatggcctgacgcgctcgctggtgaagcgcagcgtgatgactctgccgtatggctcccggcagtcctcgtgggcggacttcatcatcgaagactacctgaagtgcggcaagttccccacgctcgacaaggccctgtacggcccagcagcgcgcttcctgagcaagcgcatgggtgaggccatcgccgacaccgtggtcgccgcagcgggcgcgatggagtggttgcagcgcggttcgggtgcgatcctcaaccaagggtacgaccgcatccggtggatcacgccgtccggcttcccggtggtgcaggtgtactgggaatccgaggagcaccgcatcaacaccaagctgtgcggtaacgccaagctgtccctgcgcaagagcacggacgcggtgaagaagtcccggcatcgcaacggcatcgccccgaacttcgtgcacagcctcgacgccagccacctgacgctggtggtcaacgccgccaaggccgaggggatcgacgccttcgccatgatccatgacgacttcggcacccacgccgccgacagcgcggccctgtaccgcatcatccgggaggtgttcgtggcgatgtacgagcggcacgacgtgctctcggccttccactcagcctacccgttcctgccggagccgccgccgatgggcgagctggacctgcgccaagtccttgattctccgtacttcttcagctgacggagtttcagtacacctatagcacacaggccaaccgaggtccggttggagcggccgcgattgtaagcggaaccggtgccggaccttttggtacacctatagcacagaggagacaccatggccgaagacgccaaagtgaaagtcctgatgacgctccacccgaaccagcttgccgccgtgcggcgactgtccgggctgtcgctgtccgtcaactcgaataccacgcccttggaggcaggtatgcagttggggatggcccgcgtcctgaacatcttacaggagggtttcaccgttgatacctccgtaccgaacaccaacgacgggtgatagtgagcagatcaaggcggctttaacggccgctttgtatctgtcatctagagaagatagtaaggtagacaacagagagtcttctgtaagctacaactgtgatgatcctgattatacagtagctctgataactcagaacttagtagatgcagtcatcatagatgaagcctacctgctatgctttgccattgtcacaccgtggtattccaagaaccgtactacgttcgttgagaacatggtgctgcgcattgggccgggcagttccttcgaccggtacatagccgtgatggaacatctggctgacatcaaccactgcgactccctgagcgcaggcggtgcactagctcggaactcccgagcactcacacggatgtatgcacgctacggctacctgctggaacggcatgctccccaattcaccaagcgaaggagttaacctatgggtagcatcgttggtggtgggtctgcaaagaaggctgcgctgaagcaagcggcggctatcgacaagcagaccaacctccaaactcaatccacgaactaccagattcaggcgatggccgatcagatggcgcaggcagctgcacagcaggccgcatccgagtacgccgagaagttgctgagtgcccctgtcgataccgtcgatgtgcgactgggtacttctgacctcgacttgcagaccgccgacctgatcggccgacgcaagaccgcccgctccacctacacccggcccgtgaccacgaccgcagcttcccggctgacgaccgtggccgggtcagacctgttgtgaggtgagcatggaccattcgatccaaaccgctcaccgccagttcgaggcttacgacaacaagcggcagggcatcatgtaccgactcgaacgctattcgagctggactgtccccaagctgttccctcgcaagaaccgcgatcaggacaccgagccgctgacccacgggttccagtctctcggcgcacaggcagttaaccatctggcgaacaagctgatgatgtcgctgttcgcaccgtcccgaccgttcttccgattggagctgaagcgcaaggcgaagcaggctgcgcaggaacagggcgcggacttgcaggccatgcaggcaatgcttgcgaaggccgagcaggacgccagtctcgaactcgacaagcgctcgatccgctcccgactgtacgacctgctgaagatgctgatcgtgctgggcaacgccctcatggtgttggagaaggacacgatccgcgtgctcaacatgcggcactacgtggtcaagcgcactcgcactggcgaggtctacgaactgatcctccgggagaaggtgcacaagacccagctggaacccgccgcactcgctgctattgtcgcacacccggacttcaagcccgatgacgacggcatggtgtgggagtacaagtgggtcaagctggaccacaagaccggcaagtacaacgaagacgtgtggatttgcaactgcaagctgcccgcaaacttctcctcgacctactccgcagacaagctgccataccgggcggtgagttgggacttggccgcaggcgacgactacggctccggcttggtcgaggactacgaggcagacttccagtctctctcgatgctgtccgaggccgcagtgcagggcgcgatcctcgcatccgagttccggtggctggtcaaccccgcaggtcagacctccgtcgaggacttcatggcatcgcccaacggcgcggccatccccggcatgaagggcgacatcgagctgattaacgcaggcgtcgatggcgtgctgcaaaccaaccaagcaatccagtccacctacatcaaccgcatcggcgcaggcttcctgttgcagacggcggtgactcgtcaggcggaacgtgtgaccgcgcaggaaatccgcatggtcgccgaggaactggaaggcgggctgggtggcggctacagccgcatcgctgcggacgtgcaggtgccagttgccttttgggtgatgaacctcacgggccgcgacatccgaggcaaggacttggagcctgtcatcatcaccggcttggccgcgctctcccgaacgggtgaccgtgaccggctgttggagttcggcagcaacctcgcaaacgtcctcgcgctgccgccgcagattctcgaacgactgaagctgtccgcgtggatcgccgacctcgccgccgctggtggcttggacccgaacgtatacgtgctgactgaggccgagtacggccagatgatgcagcagcgtgcgcagcagcagctggtcatgcagaacgcatcgcagcagatcgacaacgccaacaacatggagacacagacacaatgagttccaacgcacctccgggcggtggtcccggcgcaaccgtgatcgcaacctcgcacggcaaccagcccgccccggcagctccggctccggctgacgacaagctgctgcccaacggacagcccgcaccggctgcaccggcacagcccgcagctcctgctgcgcctccggctgctgacgctctgagtctcgaacccgctgctcccgcacagcccgccgccccggcgaacgctgcgccgactgctgtgtcgattcccgactacggcgacaacggcctgaacatcgcggccgaatacttcgtcaacaccgtcggcctcgacatcgacagccgcgaactgaccgaagcagcgaagggcaacttcgccctgctggaagccaagctggaagtcctcggcgataaggccaagggttccgcaccgatcctcgctctggcgaaggagagcatcgctcgtgtcaccgccgctgcaaccgcagcgcatgccgcgaacgttgctgctgtccacgaagccgtgggtggcgcagagaactgggctgcgatccagcagttcgcacgggccaacctgcccgccgaccaactgaagcaggcaagcgaatcgctgtcggctggtggcttcggcgctcaggcgaccgcgcgttacctgatggctctggcacaggccaatcccgcgacgaccgtcaagggcgcaccggctaccaatgccgccgctcctgccgcgtcgatcaacggcgtcgctcctctcacgaaggagcagtaccgcgctgagtaccgcaagctggttgccgagaagggcatccgtggtgcggcccactccgaagaactgcgtgcactcaacgcgcgcgtcatccactaagaaccaaggagcaacataaagcatgagcaccatcttcccaaccgtcccggttctgccgaatcaggtcaaccagtccggcaacgagaacgcgctgatcctcgaacagttcaccggcgatgtcgagcacacctacgtgtccagctcggtgctggaaaagttcttcccgcgcaagcaggtcaagggcaccaacaccctgaccaagaaggccatcggccgcaccaagcttcagaagctgaagcgcggtgatgcgccggacggcaccccggtggacttcagcaaggcgtcggtgaccgtcgataccatgctgctgtcgcgtcacagcatctggcagctggacgaaatcttcaccgacatcgacacccgcaaggaaatcgccatcgagcagggtcaggaaatcgccgagttcgtggacctgaccatcagcatcgccgccgccaaggccgctgctgccacgcagtcgatcttcacccgcaacggccgcgcgccggaaggccacttcggtgccacgcaggtggtcctgtccgctgccggtgacgagaacgatccggccaaggtctacgccgccatcggcaagctgttctcccgcatggaggaggagaagaaggtcaagccgcagcgcgacggcgtggtcctgatcgtgcgtccggcgatcttctacctgttgcagcaggccgagcagatcagcaacggcgagtacctgacctcggacggcaacaagctgaccggcatcccgaccttccacggctggggcgtcccggtgctgtcgagcgagaacctgccgaacaccgtgatcgaaggtcacctgctgtcgaacgacgacaacgacgacttctacgacggcgacttcagcaccctgatcgccgtggccgtgtcgccgaaggccctgctgatcgccgaagcgctgccgttgcagtcctcggtgtggtggagcgacgcctcgaagtgctacttcgtggactcgtggatgtccttcgccgttggtctggatcgcgtcgagaacgcgggccgcatcgacaaggttgcctaatccgctgggcgcggtccctgaatccttcgggtaactcaaaccgcgcccgccttccaccaacacaggagcaccatcatggtctttgaccgaccgttcgagatttccaaccgcgtcgtcgccgctaccggcgtggccggtctgcccgacaactccgtgggcaccgtcgtcggcgtccactacgacgccatcggcgcgggctgggtcgtgcgcgtccgtttcgttgacgacgaaatcggctcgcaggacgtggagtacgcaccggcctcgctggctctggctgcggactaagcaacatcccggcaggggcgctacggcgtctctgccttgttcctctcaggagacaccatggcattcatcaccaagctcgacatcgtgaacgcctgcatcaagacgatgggcgagacgaagctcaacactctggaagatgaccacgtatacaaggacgacgcagttgacttgatcgaccgcgtgcaccgcgacgtgtcgtcgctctcgctgtggttcaacaccgaatgggtggagctgaaaccgcaggcaacgagcaagtacatcatggtcccaacggacgtgctgaagctggactgcaacccgagccgattcggccacgtggtgcagcgcggacgccgcctgtacgaccgcaagcgcaacacctacgagttcgaccacaacgtgcaggccaagctggttcggctgctggacttcgatgacctcccctacgaggtgcagatgttcgtgcgggacgacagcgtgctgcgtttccagtccgacttcgacggcgacaacaccaagtacgccaagatcaagcagcagcgcgacgactcgtggatcaacatgaaggccgagcatatccggcagatcaaggcgaacccactgttcgcgcgtgcgtccgtggacgtgctgcatcagcggtacttcaactacagcggacacccgtggcatagccactacactttccccggctaaggaggcaacatggcaaaggcaggcggaacctatcccgacatccttcagggtgtcagtcagaaaccggcgcaccgtcgtcggccgggccagacgcacgagcagatcaacgtgctgtccgatccggtgaacggccttgtgcgccgtcgtggtacgcggttcgctgcttcccaagccgttgtcacctcggccgagctgcgcaacatggacgtgttcgacttcatgcaggaaggcaaggagtacgcgctgctgtatcggcgcgatccctctacctcgggaagcgagacgttcgcgttcctttacaacaagacggacgaggcgttcatcccgctggtctacgagaacagcacgtgggtcaacacgctggtcagcggcggcgcgtcgtcgctcgcggccatcggcagctacgtctacatcgcgggcaacaccacgatcccttcggccaccagcacgaacgtgtggcaggagcagacgaacatccagcgcctcgccgcgtgggttcgcaccggcaagtacaacacaacgtacacggtgaacctgacgcgcacggacaacacggtgctgacggttacgttcaagacggtgaccgcatcgtaccccggcacgctcgacacgagcgacatcccgttctacctgcccggtggcacggagccggacccggcgtatcagaagtacgtcaacgaccgagtgaacgagtacaactccgcagtcaacgagtggatcgtgaccagtgccgagcagacgcgcccggagtacatcgccgagcagctgtcggatttgctggtggacgcgggcgtggcggctacccacatcaagggcggcatcatcattgacgacgaccagttcaaggacatcacggttgacgacgagggcgacggcacgaccttctacgccgcagggcaggagattaccgacgcgacctacgctgtcaagttccactggcacggcaagatcatccgcgtgcgcccgagcggtgcaggcgcggacgagacgtactacctgcgtgccgagttggagaacggcgagacttcgggctacggctcggtggactggtacgaagcgcccggcgtggagtgcaccatcgacaacctcgtgtcgcagctctacatctacaacggtgtgggctacatcgcacgcaacggcgcgggcctcacgtctctggctccgggcagcggcgagcacccggcttacggtgcgcgggttgcaggcgacggactgacctctccgatcccgtggttcatcgacaagccgatcaccatgctgtccgtcttccaagaccggctggtggtgggcgcgcagaactacgtcaacgcctcgcggtcggcggactacctgaacttctggcgcggctctgccgtcaccatcgaagacagcgaccccatcgaaatcttcgcgcatggcagcgagggcgatgtgctccggcacgccacgctctacaacggcaacctcgtgatcttcggtgaccgtcagcagtacgggatcagcggcgactcggtgttcagtccgaagaacccgcttatcaaggcgttcagtgcgaacaaggattcggtggacgcgaaggcgcagacctcgggcaactacatcttctatgcgcagtacggcagcgaaggcacgagcctgcaccagatgcgcgtcggtgcgctcaacggtcagcagacggtgacggacgaaatgtccaacgagctggactcgtggctgtccggcacgccgttgcagatcaccgcgctcactgccccgaaccttgtgatgttccgcacccgagagcacccgcaggacttctacctgtaccggtacgaggacaacaagaacaacgggcagcgtatcgtggactcgtggtcgaagttccagtaccacccggcgctgggcgaaatcatcggcgtcagcagctacaagaagaacggcctcgtattcaccgcacgcgggtcgctggtggcgtgcgacgtgttcgacccgaagggcgagccggactcgcatgcgtgcctcgacagctgggcgagttttggtacacctacgggcgtactgaccgcgagcgcaagcatcgccgtcaatagcactagcccgtacttcctgctgggttgtccctacgctcaggcgtcggacttccttagccagttcgatgacctcgatgctggtgcgctggaatacggcgtcgtgtctgaggcgctggtgatcccgaccaatccgttccctcgggaccagaacggtcaggctgtgctcgatggccgcatgtcgctgaacaaggtgacggtggacgtggagaacacggcgggcatgctcgctgcggttaccacccgcaacaacagcgtgaccaccacggacttcgagggccgcatcctcggcgactccgacaacctgatcgcgcggcaaccggtgtaccgggggcagctgaacatcagcgtcgggcgcgaagtgcgtgagtgcacctacgagattcgcagcaaggattggctcccgctccgggtgaccggcctgagctggacgggtcagactttcaacaatgtacggagggttagctaatgggttcggttaatacgatcctgcaagcgaacaacaccacccgcgttgcccgtgcgaactaccgtgcagccgttgcgcagaccgacaacacgaaccgcagcgaggtcgccaagaccggcttcgctgatttcatgcggtccctgaagaacaacgcccagctggacgccgccgcgaaggagtacaactccaacatggaggcgctgtccgaggagctgcgtgcacgccaaggggctgggcttaactcccagctccaactggcgaacgcgcgcggtgcgcttcaggcacaggccggtgctgtaggtgtgggcggctcgtccgcagacctgatggataccatggttcgcttgcaggcggaaatggacaaggagacgcaggacaacgcagtctcgctgctcgcctctcgcggcgcatcgcagacggcgcaggtcatgtcgcgcgcgtggaatgggatggacatgagccgcacgttcggccagttcgactactcgcagcacatcgagccgaaggcgatgaagcgtcgcttgggcaagctgatcggcgtggccgtggctacctacttcggcgggccgatggcaggcgaggctgtggcagacttcgcagtcggcacgtggcaggcggacaacggcaacttccaaggcatgtcgcagtccttcaacaacgcagcgcagaacgggatgcaggcgtggcagcagtccaatgatcgcggcggcaagtcgtgggcgtccactaccttcgggtacaacgacggcaccggcaagcagtccgtgaccggggcgaaggtcaccggcaacttcggcaacaactacgacaacttctccaccactacgtccggcctcggctggttcgacagtggcagcggaggcaactcaggaggcgcatggtaatggctgacatcggcacggttaccttcaacacgcagtccgcattgcagggtggcatcaacgccacccccgcactgtcgggcaacaccagcattcaaggcgctggtgtgaatcaggtcggccccgttcgctcgggatcggattggttcgagagcactggtggtatgacgatgccggacagcaacctgcccgagttcttgcaggaactggcagcgccgaacaccgccaagctgaagcagcagcagatgtgggacggcttcgttgccgcccgcgctggtaagaccatggacgagattgctgcgaccgagccgtggtacaagaaaatcttcggcgacaccaactacgagattggcgcgagcatgtataacacgctctcgcaggtcaacgaaatggagagcgacctgctgcggcgtatgccggagttgcgtaagcttccgcccgaggcgatggcgaaggaattcaacgacctcgccactgcccggatgaccggcaacggtttcgcggacacggtgttgcagaagaccttcatggatcgcgcgggttcgctgatggacctgcacacgaaggagcgcacggcgtggcagcagcaggagctggtgaaggcgcagtacgctgcgaactcgtcggcgtccactggcttcaacgaactggcgaagcgcacggcgatgctcggtaccaaccgtcccatggacgagaaggccaccgaggcgctgacacaggcgcagctgtcgttgctcgacggtctgtcgccctcgcgttaccagacggacgagtcgtacaagtcggcgatcaccgcgttctaccgtggcgctgcggatcgcggcgagttccacacgctgaagttcctcaacagcaagggcgtgctgaacgccatcgaccccgacgggcagctgggaatccagcagtacgtgaagcaggcgcaggatcggtaccgctcggactggctcgatgccaacccggagcaggccgagaagatggcgcttgtctccatgtacgcatccgagggcattggtgccaagccgtcgcaggcgatgatcgaggaaatgaacgcgacctacgccgctgagacgggcagcgatgcgccgctctactcgggcacgcagcttgcttcgatcatggcgcagtccgcaggcgcgcacatccgcgcgcaggaagccgtcatcaaccagcgcaacgctgcggctaaggctgcactgactgaccagcagaagctggcggcgcaggaggaggacatccgtggcggcatcgagtcgttcaagcgcggcacctacgcgcagacgatcaacatccccggcgtggacaaggagctgatcgaagcgaacgtggtgcaggcgtggaactccacgatggccgcgaacccgaaggtcgccatgtcgcagctggtgtggaacgccaacacagggcgcggcgctgtgctgaagggtgtggccgatcagttccagaccacggcgcgcgctgtgctccgcgatcagccgaacacggcagcggctgcgctgtaccagcagtggaaggaactgaagcagacgaccgctgcgcgcatcgacacgaacggtcagcctgtgcagggccgactgactggcgcaactaccgccgcgctgtacttcggagatagcgtcaacacgttcttcaacaagctgcaagcgttggagaatggcggcgtgaacttcgagcttgcctacgaggtggcccgtggagaaatcaccaccgacgatcccacgcagttcgacgcgaacagtcgtaaggaatccgaggctactcaggctcgtgttaacgacgctatcgcaaagctcaaccccaagtacctcgggatgttcggcaacaagctgggcgactctggccgcgctgcgtatgctcgcgccatcgtccggtcggtcaccgacagcggtgggctgctggacacttctgcggaaggtttgcaagctgcggctacccacgctaagctggcctacggtctggaagacgcgggcaagtacgcatgggagaacggacgcgacgacgaaggccgagtgatcggcggtgttggtgcgtggctggggttcatggacacgaaggagacgggaccggccatcgagaaggccatcgacgcagcactgcggcgggtcaacatcgagcctactaccagtctgaaggctgacgtgttccgcatgaaggacagcgagaacggcgagccggtgctgtacgtcaacgctgttggcgagaagggctggaaggttgtgccggtgtacgggcgcgacatcaaggccgagtacgagaagcacacgaagcagcagcggcagttgcaggccccggtaccgcagggctacgttcgcatgaacgacggtacgattcagcagagcatttccatccaacccaaactgtaaggagatagacaatggcactcgatctttcggggctgacccaagaccagcagattgccaaggctgccgcttatgcgggagtgccggagtccatcgtgcgcggtcagtggcgagtagagtctggcaacggacgcgcagccaaggacgctgacggtgtgatccgcagcaaggcaggagcgcagggcgacttccaagtcatgcccaccacgcaggcaacgtgggaagcgcgcaacggtcgcaagtacgacatgcgcaacttccaagacagcatcgagctgtacgccgacatcatgcgcgagaacatgcagcttgccaagggcgacgttaccaaggcgctgcgcatctaccaaggcggcaccaacccgaagaactggggacaggagaacgcagcctatgcaccgagcgtgctgggtggcgcatccgctcccgccgtgtcggcgcagccgcgcagcctgaccaccactcaggcagacctcaacgccgcgtggcagggcaacccgaacatgcgcgaccgcacgtggtccggcgcttccatcccggatgcgtggaccggtgctcccatcgaaggccgcaacgctctggcgtcggcagcgaaggaacacatcggcaagattcgtgcgggcatcgccgagctgtcgatgggtcaggtggcgcaggaaggtggcaccgcagagcaggctgtgggcaaggcgcaggccgtccgtgcgtcggatcaggtcgtgccgtggtgggtgcgtcaggaagtggacgtgctgaataccggcgctcgcaaggcgctgctggatcagaccgagcaggctctcgcacaggagcgtgcagacgaggagctgcgcaactcgctgaccttcctcgacaagtggggcgcggcattcgacagcggcatcggtgcggctatcagcaaccagcttgcgcgcgaggacgagaacatcccggaaggttggaagtacgacccgaaggaatgggagaagtcgtggatgaccgccgacgaactggaagacatccgtgacgctgcgtactcgccgaacgagctgaagtacgtgagcgaccgccagtggatgcgccgcaactccatgcgcatcaaggatcagcagaccggctggtcgagcttcggctacgacctcgtggcaggcttcaccgatccgggcaactgggctatcggcggcgtcaccgctgcgggcgctaaggtgctgggcgtgggttcggctgcgctggtggccgaggggcgtgtgggtgcttcgctcgcatctgccgctgcggagaacgcggtaggctccgtcatcacggacgccgctctggtgggcatgggcgagcgccgcaacttcgcggactttatgaccgacgctgcgttcgctaccaccatcggtaccgcgatgcacattccgggcgttcgctcggctgcgcagattcgggacaaggctaccatcgacctgtccgcaggcaacgctgccgcttacggcgaagcgtggtcggctgacctgaaggcgcgcgcggtggccgagcttggtgacaacgccaacccggtgctggtcaacaaccgcatccaccagcttgccaagcaggaagcagtcgattggctgcgcgctggtatggctgatgtgccggacgacttccgcatcttcgcgcgtcccgacgtgcaggagacgaccaccaccgcaggcaccactggtgcactggctcgtgacgtggacaacgtggacgcctcgaccggccggtacaacgacagcgtgggtggtcgggtagatcagcatgatccgctgctggaacgtgcgtggaaggccgcaggcatccgtggcggcaacgtggacggcgtgctgaagtatctggaatccaacgcctcgatcccagaggacgtgcgtgctatcgccaatgcgctgaagcgcggcggtcgcctgagcacggtgaagatcgtgccggagtcggaactcgacaagtggttcgccggtgccaacatgggtccgggtatgcgagtggccggtggctacaacgccgggctggacgcgatggcgatgcggaactacacgccggaagtggtggtgcacgaaatgctgcatgctgccaccctgcgtgagctgcgcagcaactcggtgttcggtcaggaaatggaagaactgctgacccacatcaacaacagcatcggcagtgtagactccacgctcaccaccgctgcaatggagacgcgcatcaaccagccgcaggcaggcttcctcgccaacaccgacgagctgatttcctacggcctgacgaaccgcgccgtgcaggcggtgctgcgtcagatgcctgcgccgggcaacacccgcccgaatgcgtgggagtggctgaaggacaagatcgcgcgagtgatgggcctgaagaatcaggagtccgctctcgaacgtctgatgtctgtggtcggcgacaacctcggtgctgaagtgcgcgacacgcaggcatcgactcgacagactcgtggcatgctcgccaactcgatcttcaagtcgaaccgcgagcgcaaggcgttctatcagcgcactggtctggacaagtccgtcagcgacgacgcgatgcgcgtgcaggttgccgaggtgatggcgcgctctgagcgcttcagtgccaagtacggcatcgacgcggcgaagctgtccaccatcatgcagcgcttcgggctggaagctacgagcacgaccctgatgtcgtccaagtcgccggtcgctcgtatgcttgctgtcaccctgttggagaacccggagggtgcggcaggccgacacagcacggcggcgatggatcggcatggccggttcgagtcgttcatgggtacgcgcccgcgtcagtgggaagcggcctaccgtctgtggcgcgcggacgttcgcggcatcggtgcgatcaaggacttcgccacgggctggaaggcacgtgcggacttcgagtacgcagtgaagctgtaccgcgagactcgcttcaacggtggggacatcccggatgcgcacgaggcagtgaaggcaatggcccgtgagctggaccgtggctacaaccgcatggcagcagagcagcgcgcggctggtacggtgggcgcacagcgtctgccggaggaagacgtggagggctacgagtcccgcacttggctgggtggcagcatcgctgctgctggtccggttcgccgtgagggtatccgtcaggcaatgcgcgatcagttcgaggtgatgggcgagctgtatggggacgacttcctcgacaagttcgctaccaagtatctggaacgcatcgagcgcaaggcggcgggtatcatcgaagcgccgggtcaggtcttctcggagtcgcaggcggacacgctgcgcgatactctgcgggcgatgtcgctcaacgaggaggagattcagaaggtgatgggcaagtacagccgtggcggtgcgaagcacaccaaggcgcgtatcgacctcgacgtgaccaagcagtacgaagatgctgatggcaagttccgcctgatggactacctcgacaatcgcgtgatggacaactaccgcaagtacgcgggccgtgttgctggtgacatcgctctggctaagcacggcatcctcggtgatgcaggcatcaacgtggctcgcgaagcaatgcgcctgaccggtgcgactgacgtggagctgaaggcgttcgagcaggtgatgtccgagttccttggtcgcccggtgggcactggtgatccgactgttctggcgaatgcgcggctgctgacctcggctatccagctgggcggcgcgggcatcaatcaggcagcggagtacagcaacggcctcgccgctgttggtgctgctggtgtggctgacgcaatccgtatcgctcctcgcatgcgcagcgaaatcatgcgcatcctgaagggcgaggacagcggcaaccaaatcctcgacggcttcgagttcatcagcggtcgcggcttcggcctcgccggttacgatctgcacatgttcaactcgctggacacgcaggcgtcgatgtacggcagcgagcgcgcaggcttcctgacctcgctggtgcagaaggcagcgcatgcaaaccgcatcctctcggggcagcgggctgtgctcgccgtacagcagcgcggcttcgcggaagtgctgatcgccaagggcgtgaagttcctgcgtgatggtgccgaggccgacaccgccctgaaggacatgggcattgacgacaacctgctgaaccgcctgcgggcgacgcaggatcgggtcgtgcgctggggcgctgacggtaagctggaagcggtggacccgcgcaacgtcgaaggactggcggatcggcaggcatggttggcgttctacaacgcgatcaaccgtggcacctcgcagattcttcaggacaccttcatcggcgagactggcaagtgggcgcacaacggctggctgaagctgctgttccagcaccgcacgttctcgctggtcgcacagcagaagcagctgggccgctacgtgggcaactacggtgcgtggcagactgcgggcctgatcgctgcggcgatggccgtggctgcgccgctgcaagccctgcgcgtgctgtcccgcgtggccctgatgaacgatcaggagcgcgacgaagccatcgaccagaacatcctgtcgcctctggcgctgggcaaggccacgctgaactacgtgtcggcgacgggcatgctcaacgatgtgctggacgtgggcaccggtgtggctggtggctggtacgagtacgccaccgatacgcagggtccgacgtggctgaagcagctggccggtgggcagttcggcaaccgcaaggaagtggtgggcgggcagttcgcgcccgcgctgggcgtcgtcaatgacttcgctcaaggcatcgctggcaagccggagaatctggccgacgtgattccgggcgggcgactgcccatggtgatcccgctgttgaagggcgcggccagccagtggaaggaggagtgagaatcagggccaaggacggcccacccttttggtacacctatagcaaacaggaggcagcatggcagttccagacccgcagctgcgctacgcgacagacgtgttcgacgccgatggcgtgaccactgactggcagatcagctttaccggtggctacatcaacccgtcccacgtgtacgcaatgagcggactgttggacgaggagactcagctgctgaccgaccggactccgcacaccgtggaagtcctgagcgaagacgatgacgctagcaccgtccgtgtctcgcctgccgtcgccgctgggcgcaagctctacatctaccgcagcactccggtgcagcagatgctcgttgactacgttaacggtagcatcatcagcaagaccaaccttaacctcagcaacgaccagctcctgaagatcattcaggaaatgttcgactcgctcaacatcgccacccttagcatcgaccaacaggtcggcgtgatcgtggacctgaacgagattatccagaacatctataagcaggtcaccgagttgctggccgctggtggtatcgtgtccgtcgccccgcgcgtctggtccggtgcatggaccggcgatcaggtggacgacaccgacttcgacatggtgggcgcggacgtgtccggcgctggcttctacgacgtgtacgtcaacggaatcggcatgcagccggacgtggactatcaggtcactctggccgacgacaccgatcccagcttcatccgcttcgccacggttcccgccgagggcagcatctggttcgccgtgctgcgtggttacgccaagccctacaccgggcctgcgccgatcactgctacgagcctgcgggtgccgatcatcccggcagaaggtccgacctactacgccgacaaggctaccgagtacggcctcgtgcggtgcacgtatgccggaggctgtgccgtcaacatcaacctgatccccgaagtgggcgacggtgagacgaagcttgcctcgggcagttacttcagcgttcagcagaaggcaggcccggtggtcatcactggcgacgtgggcgtgaccctcgaagtcccggtcggctgcaccgccgcaactcgcggcaccaactccgtcgtcactgcaacgtgcatcgacggcgacaccaacacgtggttgctctcgggcgacttggctaaggagtaagcatggctaatcacttcaggctgtacggccgaccgctgatggcggacgaggttgcagatggcctgtcggtgacgggcgtgctggaagggtacacggcgggcgaggcttacgagtctcgcctgtccatcaacaacccagtcggccgctgcaccgtggaggtcatcgaatcgacgctcccttcgggcgctgcggtacgggtggacaacatcaccaaggaagtcgtcgtcaagtgggcggctttcactgaagtcgtggacgaggaaaccctcgtacccaacggcgacttcgaggcaggcgacgatggcacgtgggttccgggcggtggatcgaacggcgaaggctggtcgattggcactggctcggactacgataccgacagcggcgtatacagcgcgcgcttcgccaacatcaagacgggcggcagcgacttgctcaacccgctgatccccgccaaggtcaacgactacatccgatgcacagccgaagtccagcagggcgcaagctccaagggcaaggcaggtgcgcgggtgtcgatcatctaccgcaaggaagatgggaccgagctacaacgcaactggggcaacatggtttcctccggcagcaacggtgcgtggcaccagtccgttgccgagggcgctgcacccaaggacacgaagtacgtgcaggttgttctctcggcgttccgcagcaagcagaacaagccgctgtgggtggacactgttaagtggaaccacaagtacgtgctgggtcagaacgacgacagctcctacttcctgagcatcaaggtcacggatgggttgaaccgtgtggcctactggtccggtcgtatcgaggagcagggcatctacgttacgtcgaagctctacagcttctaccagttcgatgccgcgatgctgaccagcagctttgctgggtacagcaacatcgacatgctacctcctttggatactgcgtcgctgggttcctccttcgtaagctgggaactgcgcagctcgcgtcaggattacgccgccgaggagagcctttcgtacggtagctctttcgtttcgttcgacatccgatccattcgcaaggactacacacccgacccggagacggcgcgactgtcgagttccttccattccttcaccatgaagcagcaccctgttgtcaatcagccgctcgacgcgactgctcgactccggtccggcttcgtatcatggagcttctcatgatccacaatcacctcggcatcgccggtgtgttcactatcagcaagggcaagtccctcgacgctctggaagttgtcgccgactggcagagcaaccttatcaccgatggtggtatggacgcactgggtgactctggcagcggatacccgcgcagcatgtacgacctcattgcctacttggcagtgggtagtggtagcgcaacccctgcgttcaccgacactgctctcggcgcgcaggttgcacaggttggtcgtacgacttcggataacggcggcaccaccacggccccgtactacgcctactcccgctgccagtaccagttcccggcaggcaccgccactggcgtgctgtccgagctgggtgccaaagcgtacaacagcaataccggcgcttacatcctgtccactcgcgcgcttatcaaggactccgcaggtaacccgaccaccatcacggtgctgtcggatgaaatcctcgtggtcacctacgagctgcgcatgtacgtggacaccacgcccgttgtcactaccgagactatcaagggcgtgagcaccaccgttacctgcaagcccatctccatgggccgtagcggcggcctgaacggccagtcggcagttgtgtggtcggactacgtgtggggctgctactacttcaccggcggcacgggcgatggaactggtgctatcactgaccagtatcctccgggtaacaacgtaagatactcggacttgcagattcagcgggtagagtacattccgggtacctactaccgggattgcgtttgccgcatgtcgatcaacaacgtccccggtagcccgatcacggctgcgatgggcctgtcctcgtgcgttgctttccaagttggattcaatccgggtatcaccaagaccggatcggaaacgtccaacctgcgaatgcgcgtttcgtggagtcgatacacgccatgatcccctctgtctcccaaagcatccaacgtggtgactgggtggagcagcagaaccggcgcacccgcccgctcattgacttcgagcagggcgggctggccctcaacgcggcagtggacaacctccaagccgcgctgtggactgccgaaagtgacggcagcagcgtcgtcgtttaccgcgacggcgttgccccggtcacggtgctgaccgactccgggatcacgcagatcgcactggcattcgaccagaccatgcgcccgcacgtggcgtacatgtcaggcggtgtgtgcaagttctactggtacgacacggtggctgcttcgatgcaaaccatggtgatccccggtgcgaccacaccacgcctgtgcatggacgagaagcgggcgatcttcgccacgcagagcgatgtgcttctgtcgtacaagaacggcagcaacctgtgcgtccgcgcgcagcgtgagcgcttcgcaaccgaacacgtgatcgcctcgggaatccccggcgacctgatcgcggtgggcatgaacaacgtcaaccgcctgcaatggaagctcgtcggcaatcccgacgactggccttaacctacaggagaacagcatgaccccgccgagtgtggtcaatgaggtcgtccgaacctcgccgcttacgctcggcgcggtctacctcaacttcatcagcacgtacggtgctgccatcgtaactacgctcgccattttgtacgccgtcgctcagttctactggcgcgcgcgcgagcaccgcaagatcatgggagggaaggatgtcgaaccccgcaagtgaaggcgcgcttggtgcgctacacgaactcgtcgccacggtactgaaggaacgcctcgccaacggcgagctgtgcaccgctgccgacatcaatgccgcgatcaagttcctgaaggacaacaacatcacggcgacgcgtgaggccaacaaggcgctcggcgaactggaagacgaactcggcaagcactcgctgccgcaggccgacgactccgagcttcaagcagcgctcgacaacatcgtgaactttccggggagcgtagccaaccatgcgtgaatcagccgaagcggcagacatccgtcgccgcaagttggagctgttgcagaaccactaccgccacttcgccaccttcatgcgcgacatcatgaaggtgctggggttcgagccgacgtggatgcagtacgacatcgccaactacatgcagtacggcccgcacctcgcaatggtgcaggcgcagcgaggcgaggcgaagtccaccatcgccgcgatctacgccgtcttctgcttgatccacgatcccactcaccgtgtgctgatcgtatcggcaggcggcacgcaggcatccgagattgctacgctgattcagcgcatcatcctcacggtgccgactttggagtgcatccgcccggacaagaacgcgggcgaccgcacctccgtggatgcgttcgacgtgcaccactcgctgaagggcatcgacaagtccccgagcgtggcgtgtatcggcgtcaccggcaacctgccgggtaagcgcgcagacctgctgatcgcggacgacgtggagtccaacaagaacagccgcactgccgcgaaccgcgagctgctgctgaccatcacgttggagttctcggccatctgcaccggcaagcccggtactcccggccgcatcctgtacctcgggacgccgcagaccggcgactccatctacaacaccctgcccggacgtggctacgacgttcgcatctggcccggtcgttaccctaccccggcacagcgcgagcactacggcccgcatctggcaccgtctatcgtgcagcgcctcgaagctgacccgatgttggcgtttggtggtggtccgatgggcgacgagggccagtgcaccgacgagctgttggccggtgagcagaagcaccagtccgaactgcgtcagcgtgggccgtccagctaccagctgaactacatgctcaacacgcggctgatggatgcgctccgcttcccgctgaagaccgagaacctgatcgtgatccccggtggtggcgaccgcttcccgctgacgatcacccgtggcctgagcaacgcgcaccagcgcagcttccagtccagcgggtacggcttcgtcatgatgatgccgcacgacatgagcaccgagactgccccagtgcagggcgtgcacatgcagatcgacccggccggtggtggtgccaacggagacgagacggcgttcgccgtgaccgccttcctcaactccaccgtgtacgtgttggccgtgggcgctgttcccggtggctacgacggtgacggcctgctcgaactccgccgcatcgcggtgaagtacaagccgaacgtcatcagcatcgaaaagaacatgggctacggcgcgttcgccaaggtgttcctgcctgtgctgcgagaagatcgcggtaccgagaagggatacaagggcgacatccgcgaggagttcgtgaccggcaacaaggaagcccgcatcatcggcacgctcgaacctgtcatggctcgcggctcgctggtcatgctggaatccgtggttgaaatggatcacgagtacactcagcgctacgcatccagcggaaagcgtcaggtctacagcctgttccaccagatggcgaagatcacgcagcagaagggcagcatcgcacacgatgaccgcctcgatgcactggaaggaagcgtgcgccactgggttgcgcagcttgcactggaccagaacaaggccattgccaagcagcagcagcgagagttccaagactggatcaacgatccgaccggcatgaaggcagcgacccgcaagagtccgctgcaacgtggccgtccatccctactcgaccgttaccggaggtaaccaatgcagaagtccgacttcaccagcaactacacgggcctgttcggccgtggcaactacctgcaccgcgaactgctcgccctcgtggagcatgcggagcagcatcccgcaaccgcagcgcagctgctcgcccagttccagaaggacgcgaccctcgtgctcgacgccctgatcgctgccggtgcgcgcacgcagtcctcgggtccgaactccggcccgcacactccggtcgatctggacccggacgatgacccgctgaccccgtaaggagcaaccatgaaccagcagcagaaccaagataccagcaacaaggggctgttcggcctgatcggcggcatcttcatcggcatttcggcaacgctgctgtcattcacccaaggccacgaaggggtacgctacgctgcgtacctcgacaccggccgggtgccgaccatctgctacggccacaccaagggcgtagcgatgggcatgacggcaacgaaggcacagtgcgacaagtggctggtcgaagacctacagatcgcccagaagggcgtgcgtaagcacctgaaggttcccgttaaccgcaaccagatcgacgcctacacggacttcgtgttcaacgtgggcgagaaggcgttcgctgatagcaccatgctgcgcaaggcgaacgcaggggatcgtgaaggtagctgcaaggagttcctgcgctgggtctacgtcggtaagctcgactgccgactgtccagcagccgctgctccggcattcccaagcgccgcgacgcagagtttgccctctgcctgcgccccaacaacgaggtgatccaaccgtggaaaccccaagtgaagtgatcgcacgactcggcggcaaggctatcggcctgctgctggtcgtgaccatgttcgtgtgcttcggtctgtacgtctacggcctgcaacgcaaggtggagaagctggaaactgcccaagtcggcacgaccgctaccgccaaggctgcgcagactcaggctaccgggtacgcaacctacatcaaagagaaggaggatgtgcgtgttcgcaccgaagaagctctcgacgccgttcccgagtatcgtgacggcactgttcctgctgatgtcgctgacctcctgcgcgaacctgccggttcccagcgatgatctactgaaggactgtcacatcacctacctcggtggtgagcgcggcacgtcttccagtcaggacaaggtggtcaagctcgcgcaggaccgccgcatggacaccgttctgtgcaacaaggacaaggccgcgctgcgtgcgtggaaggaagaagtgtgcggtaccggaaagcgccggtgtacgggggacaagtgaccaccatcgcgtgggacgggaagcacctgtgggcggacagtcaggccacacagggcgaccacaagcacaccgtccgcaaaatcctccctgtctcgacacccaccggccctgtgctgctgggtgtcaccggggacttcacagtgcttcgcccggttctcgctgcgcttaaagcgggcgaagggtacgaggagcacgttggcaagtccgccacggtccttgtggttaaggacggcgtactcacggtcactactggtaagcagcagtgggttgaggaggctccgtacttcgatggcagcggcaaggcgctagctctaggggcctatcatgcgagcaagtctgtggctaaggccatggctgccgcgatagctcacgatgtgtatagctccgggcctatcatcaagctaaaggcaccagttcgcaaggcttagtcataaggccacgtggatagccggaccaaaatttgcttcggaaatgcgcgggggtcactccaatagaagctcccgcgcgtgcccccgtacgccctcgcgttacgcgcctgcgggtgcgcccgcctgcgtgctcgcgtgtgcgcctgtgtgcgcgtctgtgcgcccgcgtcaaggttccgcgtgggtgtgtgcctgtgcctgcctgcgcgtggcgtgtgggcgcgcgtgtgcggccgtgcgtgcgcttgcgtgggcgggtgcgcctgctgcctgtatggctggaccgtgctgccgtagctgaatggttaataaatcttccgcgattggtgcttgacggcaggtcgggagtgtggtttcatagcgtcactggggcagcgacagggcctcaggagggccgcaaggggcttgacaggtgcatacctacctgctaccatgcgaaccgcagctgtaggcgtgtgagggccatctgtatcgtttcggccttttggtacacctatagcacacagtcggctcaacctgaatcaccgtctatcggtactctgtcgagctgataagttagctacccgctaggccaacggttgacacacggccgcaatggtagtaagctgcaacgcaagtcgagtgacgtgatccgtagtggcgccgccaacaagtgggctaagggtacatgggagtcactggttagggatgcgaggagctaccgaaccacgcttgacactgagctagcagtgagctatgatagg

SEQ ID NO: 21 - DNA, 43940 bp, Unknown
  Bacteriophage Xfas303
gatgatggctccacgttggaagcacgggccgcacattggatgcaggccacggggccaccagcgggcctacagggcgcacgcagggcttgacaggggcaaccctaccgggctatgatgcggacgcactgagggacgggagggcggcatctgtatcgttttccttttggtacacatacgacagagggcatgtcctgaaaatcgtatcggtctttagccggaagtgaaccaaggggttgacagatagcctagctatagactagcatcctccctgcggtcgccgatgcaagccacacggcaagcattgacagccaagagggttgacagacggttagcatagtggtaagctagtggtcagtcgagtaacaagctatgagcaagccgctgggacgccttcgggcagacgacaagggcaagcggccttagctactggtaggattatgcgaggagctaccctaccgggcttgacaggaagccaagagtaagctactatgcaccaacggtcaggaagcctaaaggcggagcgactactagcggactaccggcttacatggtaggatggtggcgacaggacgcccagtcgagacaatagggcttgacaagatgcaaacggtgcgctaccataggcaccaaggctgaaggatcagctaagactaccgctaacgggtagggtgtaacgggaagcctgcgacggagctaatgggatagctctaggtggaccgccaagctgcaacgtagcactagcggataaccggatgaactgggatgtcaaaggcccatagaatccaccagacttgcaacactggtgccgctatacctactgctaacgggtagggtttcccatctgccgtgagagtcggccacgggaagcaacctgtcggaatacaggaagccggtcatagctcggggcagttccgggcaccctcactggagggatacgtgcaagcctacgggacacggtgactatggcactgtatgcccggagtaaggttgacaacccgaaggggcatacagattgaagcggcttcacggttcgatggatagcggtagctccgcaccagtgtgcgcccacgataggcgttgttccgttgactactgcaaggcttacaggagggattgcagcccggcctgtagaagccgcttcaatctgtatgttttcgctttctcacagtgccaatggaggcaccactatgcacggcaacgctaacctcgaacgcacccgcaccaagcgccgcttttgccagttcacccggactgcaagcgtgatggacctgcggacgacggagtatgaccgcaagctcgcccagcgcaagcgcgacgcagaacgctacgaggcacgccacggaaccgccggaaagcgatctgtgtttgtcgctgggaatagcggcacggcaagggcgaatcatgcggcggatcgccgagcctacctgtaacaggacgtatgacgatgcgccttcccttgcggagggcgtatctgcgtgcgactggcacgataaccgagtggaccagaccatgaacatcgagaccaatgcggccaacatccgcaagagcatcaaggccatcaatacggcgcgcaccaagctggtggacacgatccagcagaccgccatcgccgtcatcaaccatgcccacgtccacggcgacgtgactctggcgtccgacctgtgccttgccgtgggcaacggcatgaagcacgaggcgctgcgcctgtacctgtccgagttcggcccgatggctccgaacgacgacaaggagaccaaggccgccatgccgatgaagtacgccaagagcaagcggctggagggcgaggagctggccgccatgctggagcgcgccgccgccaagatgtggcacgacttcaagaccgagaagcccgccgaggagttcagcttcgctgcggacctgcacaagctgctgggccgtctggagaaggccgtcgagggcggctatactccgtccgaggaggagcgcgccgtgatcgaagccgcgcacaaggtgccgaagcccgccgccaagcgcaagagcgccgaggtgaaggcatgagccgcctcacgggaatctacggggagcgcgttgttgcgctcctcctcgctgcggccatcgccgcccgtgcggacatcgacgacgagaactcgcttggcgaagccctgtgcgagaagctcgccgaccagatgcaagacatccgctatcgtgacgactacacccaagacgaggtgggcgctgccgtggacctccgcacgcagctctaccgggagtggccggagtggagcgggtgcagcacgtacccggtcccggcgtcgggcgaagatgacgacatgatcgacgagtaccgttccgacaacgaaatggacacggtggactgggacgatcccgatgcagccgctgccgcctacttcgacgcggtggacgagtgcgccctgtacaacggcaacatgtacgacgaggacagcgagtatggccggagccgtcgccgcctgctgaccttcctgatcgacgaactgaccaaggagagcgtgaacgcatgactaccatgaagaccaatgacggcagccagtacgtgctggtgctgaccaaggaacaggccgagctgctgggcacgttccgcttcagccacgtcggcggcagctcgccgctgtatgcggtgctgcgtgatctgccgcacaagatgggcgcacggttccgcaccgaggtggagactttcaacggcaagccgatcttccacgagctgatcccggcaggcgtggccggtgtgcgccgtggcgagctgctgacccagccgatggcccgcccgagtggcggcaaatccatgctggacgccgacctcggcctgctggaggtgctggtgctcgccagtctgatgaagggcgcacccattccgccgccgcgcaccgtgaccgggcgcatgcgcctctcggacatcccgatgccggacaacctgccgcgccgaccgctgcccgacgtgctgatggacgaccagactgcacgccgtgtggccctgacgccggaagcccagccgaagaagtggatcgtgcagtacctcgaacacgggaatagctgggtgagctgcgttggcaatgggcagatcgccaactcgacgtacacctcccgcaacgaggcgtatcgccagatgcgtgcgaggatcaagcgctacgggaccaatccgaacagctaccgtgtcgtgccgagcaccacgccgggcggcccggagcgtgaccgtggctactacgtggtggaatacttccgcaaggtgaaccgcccgctcggctggggccgcagcgaaagccactggctgcgcgacacgttcccgtccgccgagggcgcacgcctcgccatcaacacccacgttcccatcgctgaccgccaccgctaccgcgtgaagtggcacccgaaccgcacgtgatctaccgctgcgccttccaacgagggcgcagctttggaatcacgcccaacaaggagggcacattgcatgatccccgtcatcttcaagcgccgacataacggcaagcgttcgccgatgcaactggctgcgcagccacgccagtggaaagagttcgtgacctacgagcacagcgtagagcgctggtatgcgtaaggtcagcctgcgttaccgcgtccacatgacgagcctgaagacaggcgcgcagtggtacagcggtcagcacctcggcgcacccaatggatggacgttcgaggatcgagaagaggccgaggcatgggcggcgctggtcaagacaaacgaccgcatcgctgatgtcgaggagtacgaaatcccacccgtcaatgaggagaatcaaccatgagcaagacctacttcggcatcacccgtgccaagggcaccaacaccatcgtcggcgtcgtcgccaacccgaacctgaccggtgcccgcccggccaccaccgaggaagtgcaggaaatcctgtccaccatcaagcctggcgcgaccgatagcctgtcggatgcactgcgtgacggcacctacccgaaaaccgtggtggtctgggacaagcgcgccgccgcccgtgctgccatcggcgagctggaatccttcgagtccccgcacttcgactacggcgtcggcgagttcggcgacaaggtgcgcagcgtgcagcccgtgctgggttggcgcatcaagtacgacggcgactacatcagctgctacaactccgtcgaggacggcgcgaccgtccgcatcgacggcgacgaggagaacaacgacgagagcaacctgctgttcccgacccgtgccgccgcccgcgaagtgctggacaccctcggcgacaagcgcagcaagggcaacccgtcgggctacttcatcgaagcggtctacgccgatgcgtaagctcggcctgcgcctcctgatcctgctctactgggtcgtcgggcgtggtccgtggatcgtcgtcggccagtaccatgacgatgacggtaggctgtgccggttccgcaccggcgaggcaactcccgatgggttgtgggtccgcacctacgacaacctcgacgaggccaacgactactgcacgctgcgcaacgagcaggcaatgaccgacccgctcggcaccacgtactacgtgtggcatgagctggagttcaaccacttccacaacaaggagaaacgctgatgggtttcctcgacaagatcaagagcgccgccaagtacatcaaggacaaggtggtcaacgccatcaagccgcagcacgatgacgacaacacgccgcctcctgcgccggacacctcccgctacctgcacgtctcggtgccgctgattcccatcgagaacccgctgctgcgcaagatgctgggccgggactacatgtgcgggccgggccagacccgcaacgtgggcaacaacgcgatgaaggcagcggccgatgcgatgggcgcgaacaacaaggaacgccgccgcctccgcaccaagatcaagcgccgggcagccgagctgcgtgccggtgcatcgttgcagccgaacgtgcaggccgcactggcaggtgcagcatgagcctgcgcatgggaagctgggtcgaggtgaccgtgcctgacagccgactgctcaacgtgcagccggagattgccgccgccgtcaagctgatcggcggtgcgacgatgaccaatgcccgtggcctgtacgtccgcaaggataccggcgcactggatgacgaggcggtgaccgtgatccgcttcgacatgaacttgcagagcgagctggtggaccagtacatgggcgccatccgcgccatcgtggaccgcctgctggtgctcggcgaggagagcgtgctgcgtcgtcgcttctacaatggcggcggcgggtacaacagcgagctgatcttccagtaaatctcgcactgattgcgtgccggaagggaccacgttacggaccacccatcaacccgtcaatgaaaggagatacaccacatgtcgaacgataccaacaccgcccagcagacccagttctcgcacgccgaagtcaagctgaacgagctgcgcgaagaccgggccaaggcgctggagaaggtgagcaagatcgacgagaagatcgccgccatcgaagcgagcatcgccaacgaggccgccatcgaagcgctgaaggcaggcgacgccgtggcctacgtctacggtcgtgccttgaacaagcgcgtcctgtccggcaccgtgtcggccaccaagaagaacgagaagggtgtcgtgcagctgaaggtcgagcacggcgagggcttcgacgccgagttccacctgatcgacgccaccgccctgctgttcaccagcgaggacatcgagaaggcgcaggccgacatcgacgcagccaaggcggcggccgcagcgggcggcgaaggcggtgccgaatgaacgcttccgccccgagcaccgcacccagccgcacggcgttcgtcgccgggcgtgacctgaaggtcggctacaactaccgctgcatcgccaccggtgatggcaccgtggtggacggcgacacctacttgctcgtcaccaacgtcaacgacaagaagggcaaccgtcagctggtcaacaccagcaacggcgaggtcgccttcgcaactccgggttcgatctggagccactgacctagcgaggacaagatgagcaacgaactacctgacagcgactggctgccgcatgcggaacgactgaaggtcggcacccgcactcggatcaaccatgcgtgtggtgagggaaactcgttgctcatcactcgctcgcacgacaagtccaccgcatactgtttcaggtgcggtggcacaggattcaagcgtgagcacgagagcttagaagccaagctagtacgaacccatgccgagcaaaccagcgagcgcagagtgcgcgcaactgttgagttgccagagccacgtgtctatgacacaaccgagtggccgctgcgtgacaaggtgtggttctacaagatgggcctctcgcttcgcatgatcggggaactcggcctgtactggtgcccggacatcgggcgcgtggtactacccatcatggaaggcgaccgccctgtgtactggacagcccggtcctctacgaggcaaccgaagtggctgactcctgatgtcccgaaagacggactcgtcgcacgcttcggcgtgggcaagggagacaccatcgttctatgcgaagacccgctctccgcatacaaggtgggactggtaacagaagcgtggtcgttgctcggcaccaagctgcacaacaaggtgttgatgcagctgattgagcgaggccaacgtgtagcgacgtggctcgacgacgacaagggcagatcggacgggagcaatcccggtcaggatgccgcaaagcaaattgccgcgcgcctccgtgcgttcggcttggactatcggaacatcacgtcaccacgtgacccgaagtattatccgaccgactacattgaggagaagctatgtcattagacttgacactgctgcgattgtgcagcgacaagggcaagttcgaccggctggtcccgaacgctccgcgcgaagggctggacgagctgaccgtgctgatgctggatgcactgcgcgcgtactacaaggagttccccgagaccaaggctctgccgcacgacgtgttcgatggttgggcgatggagttcaagttcaagcagctgccggacgacaagaagtccctgctgaagttgcagctgcgtgcgatgcgcgagtctgtcccgcccgaggcggagcagggcatgatcgaaaagctgctggagctggagcttgccacgtccgccgtcagcaagatcgtgcagtggaatggcggcgctgagttctctctgcgtgacgagctgtccgctctggccgagggcatcaccgaacgcatggaccgcaaggcccggctgcctctggtgcaggagacgcccgaggagctgatggcgatggacgagggcgacatcggaatccacttccgactgcccagcctgagccgcaacctgcgcccgatgcgcggcggcgacttcggcatctacgccatgcgccccgatgcaggcaagaccactttcctgaccagcgagtccacgttctggctcccgcagctggacacggtgtggcctgaccagaagcgcaccggaatctggctcaacaacgaggggccgggcaagcgaatcaagcagcgctggtatcagtccctgctcaacgcaacgatccccgaaatggtggagtgggcgaaggacggcagcatccgcaagcggatcgaggaagcgatgggtggcgacatccaccgcatgcagttctacgacatccacggcttcacctcaggcgaggtcgaggcgatcatcaagcagaccaaccccggcttcatcatcttcgacatgatcgacaacatcaccttcaccggcggcatgaccaacggcgggcagcgtaccgatcagatgctcgaagccatgtaccaagccgcgcgcaactggtgtgtgaagtacgacgccgtgggcgtggcgacttcgcagatcagcgccgagggcgagggtgtccagttcccgccgcagtccgcactcaaggacagcaagacgggcaagcagggcgcgtgcgacttcatcatcatgggcggcaagctcaacgatcccgcaatggatcgcttccgctacatcggcacgccgaagaacaagctgcaccgcgcaggcggtaagcgtgatcctcgtgccgaggtgatgttcgacgcagagcgtgcccgcttctacgaggaggaagcatgaagattcgttggaacgaacagaagcgcctgtggtttgtggacctgccgaacggcgtgcgtgtctacacccaccgcagcgatcaggccgaggccatctacaaggcgagtgcagaagatgctcccgtcgcccgatggaagtggggatggctggtgaacaagggcagcatgtggatgggcgtgcattacagcaagcacaacctgcgctggtgcatcaacctgatcccgtgcgtcaccgtgtggatcaccaagccgggaggcaagacgccatgaaagcaggcgacaccgtagtgtgtcgaggctcgcgtggctacctgttcaccaccggcaaggagtacacggtgcagggctaccagcccgaggcgcacgacatcaacttcacatggcccgcatacgtgcaggtcatcgacgactgcggcaagaaggtctggtgccatgcgcaccgcttcgccgtgaaggaggaagcatgagttacgtgtccttcgacttggagaccacgatccgcgccacgctgaagcgcaaggcgaatccgttctacaacctcaaccgcatcgtcgccatcggccacaagcgcaagggcgacgccaagaacagcggccggtacttcaccaccgggcgtgacgaggacaacaactacgtcggcggtgcgccggatggttggctgaaggagctgtgctacggtgcgcagtacctcgtcggcttcaacatcaagttcgacatcctgcacgccatctgccaaggcccgcagaatcgcatggcatggatcgagttcatcgaccgtggcggcatggtgtgggactgccagcttgccgagtacctgctgcacggcatgacccaagagttccacatgtgcgcgatggacgaggtggccccgaggtacggcggcaacctgaaggacgacgcggtgaagtccctgtggaatgcaggggtggacacgtgcgacatcgacaagaccctgctgatggactacctcgtcggcaccaacgacaccgacgacgtgggcgacatcggcaacaccgagaagatgttcctcggacagctcgatgccttccgggcacgcaacggcctgcgctcggcgctgctcaacatgggcgcgctgtgcttcaccatcgaggccgagtacaacggcatgttcgtggacaagccgtgggcactggagcatgcgaagaagctggagcaggagcttgccgacgccaccgcagagctggagtcctacatccccgagctgcccgagggcttgaccttcaactggaacagccgcttccacaagagcgcgctgatcttcggcggccccatcaagtacgtggcgaaggttcccgtgctggttcccgaaaccggcaagcagcagtacgtccagaaggacgagctgcactacgtgttggtggacggcaccactcggagcatcggcgagtacaacgccaacgagctgcaagccttcgacggcatcgccgagaagttccccgacgtggcggtgttcgctggtggcaagaacaagggcgagcgcaagaccaagaaggtcaaggtcgatgacctgaccaagcccaagttccgcaacgaggacatggtgttcgtgttccccggatacaccgagggcagcgagcgctgggagagcaagtccgatccgggcgtgtactccaccgcagcggaagtgatcgaggagctgggcgctcgtgacatcccgttcctgaaggcgctcgccaagcgcgccgacatccacaaggacttgtccacgtacttcatcacgacggacgagaagaccggggagcagaagggaatgctcacgctggttgggccggacggtatcatccaccacaagctcaacatgaccaacaccgtgaccggccgcttgtcgtcgagcgacccgaacttgcagaacgtgagcaagggcgagtacgacgaggagaccggcaaggagaagggcagccagatcaagcgcgcgttcatcagccgccacgctggtggcaagatcatccagtcggacttcacgtcgctggaaatctacgtgcaggcgatcctcaccgagtgccgacagctgatcgaagacctgaaggccggtctcgacatgcacgttctgcgcgcagagcaggcatggggtgcggccgaaggcaaggactacgcctacatcctgaaggcagcgaaggacgagacccacccggagcacagcaagtggaagaagatgcgaggcaacgcgaaggtcttctccttccagcgtgcgtacggcgcaggcgttgcgaagatcgcagcgaccacgggcatgaccgaggaggaagtggagaagctggtgcgcgccgaggccgagcgttacccggagctgggcgagtacatcgaccacatgatggaggtcatcaaggccaaccgcgttacgactggccggttcgtgcagcacccggacgtgccgggcctgacctgtcagctgggccgctcgcacttcaccacgccggacgggaagatgtactccttcagcgagtccccgtctcccaagttcatcgcaaccaagcccgcctcacgtggcggcgtggcgcagtcgttctcgcccacggaaatcaagaactacccggtgcaggggactggcggcgagtgggccaaggcgagcatgtacgtctcgctgcgtgccttctaccgcatgtacgtcacccaaccggaacgctggctcggccaagccctgctggtgaatcaggtccacgatgcggtatacgtggacagcgcagcatccatcgccacggaagcggcagcgctcctgcatgcaagcatgctcgaagcctccgtctacatggagtggtggttcaagtggccgctacctctcggcgtgccatgcgaaaccaagatgggcgacaacatgatggaggagcacaaccctcccgaggagttcgccgtcttgttccccgagtaccgcatgcaaatccgcaaggacttcatcggtaatcacaacccgtcgtttgaataaggagaaaccaaagcatgagtctcgacaagctgctgaagcaggtgcaggaaaagggtcaggaccagtccgtggcgtccgccggtggcggcgactacaccccgcccgaagccgggcagaccggcgctcgcatcgtcgcctactacgaggtgggccaacacgagagcgagttcgagggcaagaagaagaccaacaacgaagtcatcatcgtgttcgagctgatcggcaagaagcatccgccgaaggaactggatggcggcgtcaagattccggtccgcctgagcctgcgcctcaacctctcgaccaaggagaaggccgcatacttcaagatgttctcccgcctgcgcaccgacgagaagcacttcgtccagctgctgggcaagccggtgctgctgaacgtggtccacgtggagcgcggcccggaaggcaagaagaagacgtacgccaacatcgacaaggaatccatccgcaagccgatcatccaagtccccgagctggaagacggtgagccgaccggcaacctgctggagcaggtgttcccggtgggcgcggcgctgaccgagctgaaggcgttcgtgtgggacttcgccgacgccgaaatgtgggacagcatctacatcgaaggcgagtacccggagcgcaaggacgagaagaccggcaaggtcatcgccgaggcgcgcagcaagaacaccatccagctggaaatcgccaaggcgctgaacttcaaggggctaccgtgctacgactacgcggcctccaagctggtcggcggcaccgtcaccaaggaaggcgtggatgcgctggacgcggcggtcggtgacgtggacaacgcgcagggcgacgaggacgacaagccgccgttcgacatggacgacccgatggcaggcgtcgcctgatggacctgagcgctctgatggctgcggctgcggagcgctccccgatgcccatcgtggaagtacgacagcacaaccgcaacgtgatcgctcacgtggacggggactacgctgcgtacttctgcgctggtagcgagaactgttcagcgggggatgcacgacgcaacgtgctctcccgcgtctcgcacctgaagcatatcagcggagcggatcgtgtcgtcatgcacctcacacatggcgcgtcatcgaagggtgacaggttcctcgctgctacgactcagccgtatcaggggcagcgccagtcaggacgcaagccgaacaactgggccttcctccgcgagtggatggagacgtacgacggcccgcacttcacaccgaaaatctggacgacccgcgaggcggacgacggcatggccttcgtcagcaccggagcagccaagcacggtaacgtgctgcatgtgatccacaccgccgacaaggacatgcgaatgttctgcggcacccacatcacgtgggaggactaccacatcgtggacgtgccgctcggcacctacgacatcgtgggtgcggacggcttgcagtatgggcacaagtggttctggatgcagatgctcatgggcgacacggcggacttcatccccggcctgccgagggttggcaaggccacggcggaagcgctgctgtccggcaccaagagcaacgccgaagccgcgccgctggtgtacggtaagtacgccgaggtgaagggtgacgggtggcagcggtacttcgccgagcaggcggtgctgctgtggatgcggacggaccgggacgccacgctgctggacgtgctccagctggacgtgttcggcgacaagctgaagcaggcgttctacgacctcgccgaggatgtcaacgagaagcgcgctgcgctggaggcattgaagcaatgaagcgactgacagcagctcaggtaaagctggtgcgggtcaagctcgcagcagaacagggcaaccgctgcgcactgtgcggcggtcagctcggactgaaggcaccgctcgacccggtgctggatcacgatcatcgtactggcgcagtgcgaggcgtactccatcgtgggtgcaactcgctgctgggcaaggtcgagaacaatggcccacgttatggagtgcgggacatcctcgccttctgcggagggcttgcgaactacctgcgaaagcacatgaccaacatcacgggctatctgcatcccacccacaagaccgaggacgagaagcgtatcgctcgcaatgcgaaagcgcgtaaggcccgagcaatgaagaaggagaacccgtgaacctcaccacattcctgaagcacgccccgaagcaggggccgaagattctgtgcctcgacatcgagaccttccccatcgagttttggggatggcagatgttcaacaacaacttcagcccgaagcagatcaagcgcgactggtccctcatgtcgttcgctgcggagtggctggacgacgatgatgccacgatctacgtggaccagcgccgcgagaaggacgtgttcaacgaccgcaagcaggccaaggttctccacgccctgctcaacgcggcggacttcgttctcgctcgcaacggcaagaagttcgacctgcgcaaggtgaaggctcgcctcgccatcctcggcttcccgccgctctccccggtcagcgtgatcgacccgatgctgctgaaccgcgacgagttcgcgttcacctcgcagaagctggagtacaccaccggcgtcatcgttcccgagctgcgcaagtacgaccatgcgaacttccccggcttcgacctgtgggtggcctgcatgcagaacctgcccggtgcatgggacgagtgcgaggcgtacaacatcatcgacgtgaagtccatgaaggccgagtaccgtaagctgcgtggctggtacagcaggcacccgaacatcgcggtgtactacaaggccgacggcagcgagcaccgctgcaacaagtgcgggcacaacgaaatgatcccgcagaaggcaccagcccgcactcaggtcggcacctacctgctgctgcaatgcacgcagtgcggcggccacagccgcggacggaagctgacgaccaacatcgagcagcgccgccacatcaccgttcccgcataaggagaagcgcatgagacttaccgatgttcgccgtggcgaccgcgttcgctataccggctccgctccgggcctcgtcggtaggtccggcgtggtgcatagcatctgcaacgagtacatcaatgtccgcttcgacggcttgatgaaggagtcctacgtcaaggcccagttcctcactcgcctgatgagcgtaggaggcatcaccaccacacatagggaggttcccttgcctgagcaactgaactaccgtaacgaagacgaacgcaccccgccgaccagcgaacgcggagcgggcctgaagttcgacggcggcaaagagcagccacggctgctgcaccaaggcatgccgctcgcactggccgaggtcgtccgcaccctcaccttcggcgctcgcaagtacgccgcccactcgtggcagcacgtcgagaatgggcaggagcgctatcaggatgcgagctaccggcacgacgcggcgcgctgccgtggcgagctgttcgatcccgagaccggcatccggcaccgggcgcaccacatcatcaacgagctgttcctgctggagctggagctgcgcgaggagaaggcccgtggcgcagagtaagaagcgctccatcaaggaggcgtgggtcaacatcgccatcgggtacagcatcaactactgcgcgaacatcgcgttgctgccgctgctgtggcatcccgagcacccgctgctgtcggcgcacgccatcggcgttgcgttcacgctcatcagcttcgtgcgccagtacatcatccgccgctggttcagcaagggtgactgatggcctgcgcccgctgcggccaagtgcatcggtacgtcccacatgaggccgagtgggcgcgcttcctagaggagcatcgtacccgcaagcatttcgataccgagtgggcgaactcactctggcatcgcacataccctgacgatgcgttctgcatactcgtgatgaagggtctcgcaggtttcgttccattcaacaaggagacacaatgaactacaagtccaacacccagcgtctgatccagtcctacgagggtgccgttgcttggggcaatggcggtcacgaggaagcgttgcaggatgcggtcaacaccgcgttccccggcctgaacgacgaaggcaaggccgagctgtacgctcgcatcgccgatgcgtgggaaggctaccgcaacggcatggtgccgcgcaagctgtggatcggtcagatcgtcacggacttcatgtccggccgcatcgccgcgaacgtcggcgggctgaccgtccgcaacaacctcccgaccaaggagaccaaggccgatgagtaagccctacatcgtacacaaggccgtcgagctggacaaggtgcagaagcgtctgcgccccagcgacgacgcgctgcgcaccgagtacctcgcacagcccaagtacgacggctgcaactgcgtggtggtcaaggccgccaacgccgccgagcacatcacgatcttcagccgcaccggcgaggaagtggtgtccgcgaaccacatcaaggaagcactggccgctgcgccgttcgctcccatcggagtgtacctcggcgaatactggcacccgaccatcgaccagccgaccgtgagcggcatgttccgcaagaaggacggcacgcagtacaccgaaccgttcttcgtggtcttcgacttcgtgagcatcggcgagtgggagcagggcttcagcccgctgacctacctcgaccgcgtgggccgcttgcccgcgacgctcagcaagatcgaggaatgcaaggctccgttcttccttgcggagtcgcaaggcttcctcgtggatcaggagctgtcgccgatggaagccgcccgcctgctgtgcgagagcggcccgtacgacgggctgatcctgcgcaagccgagcggcacgtggaccaagggcgacaagggaacgaagggtgaagtcatcaagatcaagcccaccctgacgctggacctgcgagtgctgcgcgtcaacatgagcaccggagagaagaccgggcgcgacgtgtggacggtggtcgtggacctcggcgaaggcaaggagcaggaagtcggtagcggcgtgccgcacagcgcggaccagctgccctgcatcggggacatcgtggaaatcgaatccatgtccctgagcaagtacggcctgctgcgcgagccgcgctacaagggaatccgacatgacaaggcggaggcggaccgatgagtagcaatgtccgcatcgacatcacccaccaagaactcacccgcagcatcgggatcagcatcaccatcccgttcgacgactacgcccagcagctgttcccgaacgagcacctgcgcgaggtcgtgaacgaggcgctggcgcgagtcctcgacgaagcacacaaccggaggtagcatgctcacccaagcggaactcgaactggagacctatgctttcggccaagagcgcatgcgcaaggccatcgagcgtaacgaggagaacggcggcgcgccgaacaacccttacgctcaggcggtgtatcgccggttcgtgcttccgcttgcggagcgtatccgggctgacatcgacaagccgcgcatcggcagggcgcaggcccacgtgccacttctgcgggcgaagtacgacccggagcggaaggacaagcgtgggaaggccatcaccgccgaagaacaagccaccgaatggtacgaggctatcgccttcgtggccgtacgtggttgcttggcggcttgcatcgccgagcagggcaagaaggataaggctgccggtcgtgaggtggtgaagcaggtgggcaccaacgtgtaccacgagtacctgctgacccagttcgccgacgcggagccgacgctgttctaccacctgatgaacgacatggaccgcaagctgagcgtcaacgagacgcaccgcatgaccgtgatgaagatgcagggcaggaagaacggcgtcgagttccacgagtggggccaagcacagcgcgatcaggtcggcggctacctcgtcgatcagcttgcgcagatgggcatggtggacaccggcgtgatgaacgaggtcgtggtgtccggtggccgccgcaagaccaagaccaatctgcacgtggagttgaccgaggacgtgcgcaagttgatccaccagatcagcgagttcgtcatcgagagcaccccgtacttcctgccgtgcgtcgagccgccgaaggactggacggacgtggacaacggcggattccataccaacgaaatgcgcaggctgcatccgtggatggtgaagacctacgctcagacccgcgacgactaccgtagcgccgagctgcgcaacgagatggctgcggtcaatgcgttgcagcgcgtgccgtggcggatcaaccgccgtatgctggaggctgtctccgcagtggcgcaggttcacgacatggaggaaatcatttcgcaggccgagctgcccaagccgcgcaagccggattggttggagaagggcatgaccaaggaggacatgtccgaatcccagcagcgcgagttcaagaagtggaagcgcgaggtggccgactggcacaccgacgagcgcctgcgcaacagcaagagcaatcgcttctacaacgccatgcgagtggcgcgcaagttcgtggactaccaagcaatctacttcgtctacttcgtggacttccgtggccgcaagtacgtacagaccaccggcgtctcgccgcaaggttcggacttgcagaaggcgctgctggagttcggcgagggcaagcccttgctcaccaagtcggcgaaggactggttctgcatcacaggagcaaaccgatggggatacgacaaggcgtctctgccggatcgtgtgaagtgggtggtcgagcatcacgaccagattctggcgtttgctgcggacccggtgaacaacgacgagtggaagaccgcagacaagccgctgcaatttctcgcttggtgcttggagtacgagcagtggcaggtattcggggatcgcttccagagccgcatcgcagtcggcatggatggttcctgcaatggacttcagaacttctccgcgatgctgcgcgacagtgcaggcgggaaggcgaccaacctgatcccggcaccgcttccgaatgacatctaccagatggtggcggacctcgtgaccaagatccttgaagccgaggaggacgacgaggaagggttccgcaggctgtggctggaccacggcctgacccgctcgctggtgaagcgctcggtgatgaccctgccctacggctcgcgccaatcgagctgggcggacttcatcgtgagcgactacctgaaggcgggcaagttccccgagctggacaagaagctgtacgacaaggccgcacgcttcctgagcaagcgcctgggcgtcgccatagctgacacggtagtggcggcagccgacgcaatggcgtggctccagaaggcgtccacggcgatcctgcgcgagggctacgaccgcatcaagtggatcacgccgtccggcttcccggtgacgcaggtgtactgggagaccgaggaacaccggatcaacaccaagctgtgcggcaacgcgaagctctccgtgcgccgcagcacggacgaggtgaagaagtcccggcaccgcaacggcatcgcccccaacttcgtacacagcctcgacgccagccacctgacgctggtggtcaaccgggccaaggccgaaggcatcgacgccttcgccatgatccacgacgactacggcacccacgccgccgacacagcccgcctgtacgaaatcatccgggaggtcttcgtggacatgtacgcccggcacgacgtgctggaggagttcagggcggcctacggcttcctccccgagccgcccccgatgggcgacctcgacctcacgcaagtcattgattctccgtacttcttcagctgaaggagtttcggtacacatacgacaaagggtgcctcgccctccggggcaggcatcaaacccttttggtacacatacgacagaggagacctcatgtccgaaaccaagatcatctaccgactggacccgaagcaactggctgccgtgcagcgacaggcgggttccgtcctctccgtcaattccaacaccacgcccttggaggcaggtgtgcagatcggaatggcacgagttctccgcattttgcaggagggattcaccgttgagtccagcaatccgaacaccaacgacgggtgatagagagcggatcagggtggcgctagacgctgccctgtatctgtctttagccccgagtgagagtgagcatagtagctcctcagtaagctacctctgtgacgatccacagtacactgtggaaatggtagtacagaatatggtagatgcagtagtgatagacgaaagctacctactggtattctctgtagtgaaaccttggtactctaagaacaggctagtcctgtctgaggacttggtactacggatcggtaaaggtagctccttcaaggcggtcgtcgccacactggagcatctggccgagaccaacgattgcgatgccatagtcacaggcggagcactagctcgatcctctcgggcaatcactcggctgtaccaacgcttcggcttcgagctggaggatggttcgccgcaactcaccaaacgaaggagatagcctatgggttccctcgtcggaggtggctcggcgaagaaggcagccctgaagcaagcggctgccatcgaccgtcagaccaaccttcagacccaacagaccaactaccagattcaggcaatggccgaccagatggctaccgccgccgcccagcaggctgcgagcgagtacgccgagaagttgctgagtgcgcccatcgaaaccgtggacgttacgctcggaacctccgaccttgacctgaagaccgacgacctgatcggtcgccgccgtacgacccggcagcagtaccagcgaatcgtcccgaccgcccaatcgcgtctgaccggaacctccggctcggacctcctgtgaggtgagcatggacaatccgatgcacccaaccactgcatgccagcgctacgagaagctggacgggaagcgcaacggtatcctgtaccggctggagcgctacgcttcgtggaccatcccgaagctgttccccaagaagaaccgcgatcaggacaccgaaccgctgacccacggcttccagtcgctgggcgcgcaggcggtgaaccacctcgccaacaagctgatgatgtccctgttcgccccgtcccggccgttcttccggctggaggcgaaccgcaaggcccgcgccacgatgagcgaggccggtgtggacccgaaggcaatccagacccagcttgcgaagctggagcaggaagcctcgctggagctggacaagcgctccatccgcgccagactgtacgacctgctgaagatgctgatcgtgctgggcaacgcgctcatggtgttcgacaaggacacggtgcgcgtgctgaacctccgcaactacgtcgtcaagcgcgaccgccaaggttcagtgtgcgaactcatcatccgcgagaagattcacaagtccgcgatcaagcccgcagcactcggcgcagtcatcggcaacccggagttcaagccggacgacgatggcaactgctgggagtacaagtgggtgaagttcaacggcaagaagtacgaggagacagtgtggctggacaacgtgcagctgcccgctaacttctcgtcgagctacactctggagaagctgccctaccgcgctgtgacgtgggacttggcggcaggcgacgactacggcaccggcctcgtggaagactacgagggcgacttccaagcgctgtccctcctgagcgaagcgaccatccaagcagcgatcctcgcctccgagttccggtggctggtgaaccctgctggtcagacttccgtcgaagacttcgtggcctcgcccaacggcgcggcaatccccggacagaagggcgacatcgagctgattagctccggcgtcgaaggcacgctacagaccaacctcaacatccagcagctctacatcaaccgcattggcgcaggcttcctgctccagacggcggtgactcgtcaggccgagcgcgtgacggcggaagaaatccgcatggtggccgaggagctggaaggtggactgggtggcggctacagccgcatcgccgtagacgtgcaggttcccgtggcctactgggtcatggagctgatcgacaagagcatcgccggttccgacatcgaacccgtcatcatcactggcctcgccgcgctctcgcgcaccggggaccgtgaccgactgctgggcttcggtcaggacatcagcggcgtgctgagtctgcctccgcagattctcgaccgcctgaagctgtccgcgtggatcgctgaccttgccgcagcgcgcggccttgatcccgcaacctacgttctgagcgaggaggagttcgggcagatgatgcagatgcgacagcagcagcagctcgccatgcagaacgcctcgcagcagatcgacaaccagaacaacatggagacccaatgagtcagaacgcacctccgggcggtggccccaacgcaaacgtgatcgtctcgaccgcgcagcccaacggcaaccagccgcctgccgccgacgatccgatcaaggtccagccgaaccagcccgccgcaccggcgcagccgcaggctcccgcagccccggcagcggccgacccgaacgcgctgaacctcgaacccgctccgcaaccgcaagccccggcaccgagcgcgccgcaggctccggctcctgccgagctgccggactacggcgacaacggcctgaacatcgcggccgactacttcgtcaacacgctgggtctcgacatcaacagtcgtgagctgaccgaagcggcgaagggcaacttccacctgctggaagccaagatcgaagtgctgggcgacaaggccaagggcgcaggcccgatcctcgcattggcgaaggactcggtgtcccgcatcgctgctgccgccgacgcgaagcacaaggaaaccgtcaccaaggtccacgaggccgtgggtggtgaggcgaactggaaggccgtgcagcagtacgcacgcaccaacctgcccgccgatcagctgaagcaggccagtgaggcattgtcctcgggcggcttggctgccgttgcgatggcccggcatctgctgagcctcgcgtcctcgaacccgaacgtctccgtgcagggacagcccgctaccaatccggctgccgtgtccgagtcgttgcagggcgtcgccccgctcacccgcgagcagtaccgtgcagagtaccgcaagctggtggacaagctgggcatcagcggtgcagcgaagtccgacgagctgaaggctctgaacgctcgcgtcatccactaaccaacctaggagcatcactacaacatgagcaccatcttcccgaccgttccggtcctcccgaaccagatcaaccagcagggcaacgagaacgccctgattctggagcagttcaccggcgacgtggagcacaccttcgtttccagctccgtgctggagaagttcttcccgcgcaagccggtcaagggcaccaacaccctgaccaagaaggccatcggccgcaccaagctccagaagctgaagcgcggcgacgcgccggacggcacgcaggtggacttcagcaaggcgtccgtgaccgtggacaccatgctgctgtcgcgccactccatctggcagctggacgacatcttcaccgacatcgacacccgcaaggaaatcgctgtcgagcagggtcaggagattgccgagttcgtggacgccaccatcagcatcgctgctgccaaggctgccgccatgaccacctcggccttcaccaagaacggccgcgcgcccgagggccacttcggtgccacgcaggtcgtgctcgccgctgccggtgacgagaacgatccggccaagctgtacgctgccattggcaagctgttctccgaaatggaggagaccaagaaggtcaagccgcagcgcgatggcatcgtcctgatcgtccgcccgaccgtgttctacaccctccagcaggccgagcagatcgtcaacggcgagtacctgaccagcgacggcaaccggctgaccggcatcccggtcttcaaggcgtggggcgtcccggtcctgtcgagcgagaacctgccgaacggcgtggtcgaaggccacctgctgtcgaacgaggacaacgacaacttctacgacggcgacttcaccggcctcgtggccgtggcggtctcgccgcgtgcgctgctgatcgccgaagcgctgccgctccagtcgagcgtgtggtggtccgacgcctcgaagtgcttcttcgtggacagctggatgtcgttcgccgtcggcttcaaccgcgtcgaactggccggtcgcatcgacgcggctgcctaatccatccgggcgcagtccctgaatccctcgggtaactcaaactgcgccctctaccaaggagtaagacacaatggtctatgaccgccccttcgagatttccaaccgcgtttcgatcaccgccgccatcgcgtcgctgggcatcgaggccggtacgctgggcaccgtcgtcgccgtcttcggccgcgatgatgcgtggcgtatcgtcgtgcgcgtgaaggatgacgagaacggctcgcaggacttcgagctggccccgtccgccgtgaccctcgcggccgactgatccaccggcagggagagcacagcgctctctctgccttgttccctaggaggcatcatgttcatcaccaagttggacgtagtgaacgcctgcctgaagacgatgggcgaaacgaagctcaacactctggaggaagatcacccgtacaaggatgatgccctcgacctcgtggaccgtgtgctgcgcgacacctcgtcgctcgcgctgtggttcaacgtggagtggttgaagctccagccgcaggccaccagcaagtacatcatggtcccgaccgatgtgctgaaggtggacccggtgccgcactgcggcgtgcggcgggtggcccagcgcggccgacgactgtacgatgtcgcacgcaacaagtacgagttcgatggccccgtcaccgtcaaggtggcccggctgctggacttcgaggactgcccctacgaggtgcagatgttcgtgcgcgacgacagcgtgctgcgcttccagtcggacttcgacggcgacaacaccaagtaccagaagattctgcaacagcgagagctaagctggatcaacctgaagtcggagcacatccggcagatcaaggcaaaccctctgtatgcgcgggcaagtgtggacgttctgcgtcagcgcgtgttcaattacagcgggcatccgtggcatagccacaccacattccccggctaaggaggcatcatggcaaaggcaggcggaacctacccggacatcgtgcagggcgtgagcggcaagccgccgcaccgccgccgaccgggacagacgaccgagcagatcaacattctgtccgatcccgtcgaagggcttgtgcgtcgtcgcggtacgcgcttcgctgcccggctgcctctggccctgagcgaggcagcgcgcgtcgagctgcaagacatggacgtgttcgacttcacgcaggagggccgcgagtacgcgctgctgtatcgccgcaaggcgtcggcgctcggctccgcgagcttcgcgttcctgtacgacaagacgggcgagcagttcatcccgatcacgtacgagaacagctcgtgggtcaacacattggtggcaggcggggcgtcgtcgctcgcagccatcggcagttacgtctacatcgcgggcaacgacaaccgtccgagtgcgaccagcaccaacctctggcaggaggagaccaacctgcaccggctcgccgcgtggattcgcaccggcaagttcaacaccacctacaccgtgaccttgcaccgagcagacggcaccacgttgcaggtgacgtacaagacggtgacggctgcctaccccggcacgctcgacacgagcgacatcccgttctacctgcccggcggcacggagccggacccggcgtaccagaagcacgtcaacgaccgagtgaacgagtacaactccgcagtcaacgagtggatcgtcacgagcgccgagcagacccggcccgagtacatcgccgagaagttgtcggacttgctcgttgacgagggcgtgtcctcgacctacctgaagggttccatcctcatcgacgatgaccagttcgtggacatcacggtggacgatgaaggcgacggcaccacgttcttcgcggcggggcaggaaatcaccgacgccacctacgcgaccaagtaccacttccacggcaagatcattcgtgtgcgcccgagcggcgcaggcgcggacgaggcgtactacctgcgcgctgagctggagagcggcgagacctcgggctacggctcggtggactggttcgagactgcgggcgtgacctgcaccatcgacaaccttgtcgcccagctctacatctacaacgggcaagcgtgcatcgctcgcaacggtgcaggcatcaccagcatcttcccggcgagcggggaccatcccgcatacggcgagcgcaaggtcggtgacggcctcacctctccgatcccgtggttcatcgacaagcccatcacgatgttgtctgtcttccaagaccggctgatcgtaggcagtgcgaactacgtcaatgcgagcatgagcggggactacctcgacttctggcgcggaagcgtcgtgaccatcgccgacgacgacccggtggaaatgttcgcgttcggttccgagggcgacgtgctgcggcatgcggtgctctacaacggcaacctcatcatcttcggtgagcggcagcagtacggcgtgagcggcgatgcgctgctgactccgaagtctccgctgatccgggcggtgagcgcaaacaaggacagcaccgacgcgaaggctcagacctccggcaacttcatcttctactcgcagtacggtagcgagggcgtgagcctgcaccagatgcgcgtgggtgccctcaacgggcagcagacagtgaccgacgagctgagcgaggagcaggacaactggctgacgggagaaccgttgcagatcgccacggtgacggcaccgaacgtggtgctgttccgcacccgcaatcagcccagcacgttctacctgtaccgctacgaggacaacaagaacaacgggcagcggcagctggaggcgtggagcaagttccagtacgcggcatcgctggggaacatcctcggcgtgagcgtgttcaagaagtcgggaatcgtgttcaccggccgcgcaagcggtgtggtggccgacgtgctggacttcaagggcgagctggacgagcacgggtacatcgactctcgcatcgcgtacgcgaaccgcacggagaacggtgtggccgatggctccgtcgtggtcaacgcgacgagcgactacttcctgctgggcacgccactggcgcgcatcacggagttcctgtcgcagttcgatgacctcgaccctgcggcgctggagttcggcgtggtgagtcccgcatcggtgactccgaccaatccgttcccgcgagaccagaacggacaggctgttctggacggccgcatggcactcaaccgcgtcaccgccgacgtgcagaacaccgcaggcatggtggccgtggtcgctacgcgcaaccgggtgcagagcagcatcgacttcgagggccgcatcctcggcgacagcgacaacttggtcgggcagcagccggtgtattccgggcagctgtcgatccccgtgggccgcgaggtccgcgagtgcagctacacgatcagctccaaggactggctcccgctccgagtgacgggcctgtcgtgggttggtcagactttcaacaacgtgcggagggttagctagtgggtagcgtaaacactatccttcaggccaacaacaccacgcgggttgcacgagcgaactggcgcgcagctgaggcaaagacgaagaacaccaacgccctcgaagtggcgaaggggaacttctcggagtacatgcgtacgctcaacaaccaagcgaaggtgaacgcggcctcgaaggagtacaacttccagatggagcagctgtcggaggagctgcgcgcgaagcaaggggcgggcctcaacacgcaggtccagctcgctgcggcgcgcggtgccctcgcggcgcagtccgggtttgtgggtgtcggtggttcgtccgccgacctcatggacacgatggtgcgcttgcagtccgaaatggatcaggagacgcagcagaacgcgatccagctcatgtcgagccgaggcgctgcgcagacggcgcagatcatggcgaacgcctacaagggtatggacatcagccggacgttcggccagttcgactatcaggagcacatcgagccgaagcgcatgaagcgccgcttgggcaagctgattggcgttgcagtcgcaacctacttcggcgggccgatggcaggcgaggccgtggccgacttcgcggttggcacgtggcaggccgagaacggtgacttccaaggcatgagcaagagcttcgactccggcatccagaatggcatgtcggcgtggcagcagacttcgcagcgcggcggtaagtcgtgggcgtccagcaccttcgggtacaacgacggcacgggccgacaggcatccaccggaacgggcgcgaagatcaccacgcagttcggcaacaactacgacaacttctccacgactacctccggcctcggctggttcggtagcgggagcaattcaggaggtgcatggtaatggctattggtgatccgggcacgatcaccttcagcaccgagacggtcggtggcggttcgcttggcgcgaccgctgccgttccgcaggccggtgtgcaaggtggtggcgtggccccgctacaggcggtacgcagcggcagtgactggttcgccggtactggcggcatgacgatgccggacagcaatctccccgagttcttgaacgagattactgccccgaaccgcaaggcgctggagcagcagcagatgtgggatggcttcgttgcggcgcgcagcgggcagacgatggacgaaatctctgccgagcagccgtggtacagcaagctgttcggtcccacgaactacgagattggcgcgcagaactacaacgtgctgcgttcggtctcggacatggagcaagacctgatccaccgcatgccggagctgcgcaagctgccgccggaagcgatggcacaagagttcaacaggctcgcccagtctcagatgacgggcaacggctacgcagacgccgtgttgcagaagaccttcatggaccgcgccggtccgctgatggacctgcacaccaaggagcgcgtggcgtggcagcagagcgagctggtcaaggcgcagtacgcgagcaacagcagcaactccaccagctacaacgaaatggcgaagcgcgtggcgctgctgggcaacaaggcacccggcgatgaagccgaggccgagaagctgatccagtcgcaggtgagcctgctggacggactgtcgccttccgcctaccagacggacgagagctacaaggcggcgatgaccgcgttcgttcgtggcgctgctgaccgtggcgagttctacacgctgaagttcctcagtcagcgtggcgtgctgtcggcgctggacccggacgatgccttgcagttgcaggcgtacgtcaagcagaagcaggcgcagtacaagtccgagtggctggacaacaacccgcaggctgcggagcagatggcgctcgtgtcgctgtacgctgccgagggcatcggtgctaagccgaccgaggcacagatcgaccagctcaacatgagctacgcggccgcgaccggcagcgacgatccgctgtactccggcacccagcgtctgagcatgatggcccagtccgcaggcgcgcacatccgcgcgcaggaagcggtgctgcgtgagcgtgcggctgctgccaaggcggcgaacaccgagcaggcgaagctggcggcgcagcaggaggacatccgggcggccatcgactcgtggcggcatggcacgtactcgcagacgatcaacgtgccgggcgtggacaaggagctgctggaggcgaacgtggtgcagggcttcaaccagaccttgcagacgaaccccgcagtggcgatgtcgcagctggtgtggaacgccaacactggacgcggcgctgtgctgaagggcgtggccgatcagtaccagaccacggcacgtgcggtcctgcgtgagcagccgaacgacgcggcgcgcgacctctacaaccagtggcgcatgctgaagaacacgactgccaagcgcatcgacatcaacggcaatcccgtcgagggtaggctgtccggtgcgaccaccgcagccctgtacttcggcgacggcgtgaacacgatgttcaacaagctgcaagcgctggaggaatccggcgtgaacttcgagctggcctacgaggtggcgcgtggggaaatcaccaccgcggacccgaccgagttcagtgcaagcagccgcaaggaatccgaggcgttgcaggcgcgcgttgctgacgtgttgcagaaggcgaaccccgcctacttcggctacttcggcaacaagctgggcgactccggccgggccgcagctgcgcgtgcaatcgtgcgtgcggtcaacgagtccggtggtctactcgacacgtcctccgaaggtatcactgctgcgctcaatctcgccaagctgaagtacggcggcgaggatgcgggcaagtattactgggagaacgggcgtgacgacgaaggtcacgtcatcggcagcgtcggcgcatggctgggcttcatggacaccaaggagaccgggcctgcaatcgaagcggtaatcgacgccaccctccgcgccaacaacgtggagccgagcaagagcctgaaggccgacgtgttccgcatgcgtgatagcgagaccggagagccggtgctgtacgtcaacacggttggcgagaggggctggaaggtcgtcgccgtcactggcgctgacatcaaggccgagtacgaacgccgccgcaaggctgcgacccgcaccgagttcccggtgccgcaaggctacgtccgcatgccggacggtagcatccagcagagcatttccatccaacccaaactctaaggagaattagacaatggcactcgatctttcggggctgacccaagaccagcagatcgctgcggctgccgcttacgcgggagtgccggagtcggttgtgcgtggacagtggcgcgtggaatccggcaacgggcgcgcacagaagaatgcacagggcatcatcacttccgaggcgggcgctcgcggtgacttccaagtcatgccgcagacgcaggccgtcatcgaagcgcgcacgggcaagaagtacgacgtgcgcaacttccaagacaacctcgaaatgtacgcgcacatcatgcgcgagaacatgcagcttgccaagggcgacgttacgaccgcactccgcatctaccacggcggcaccaaccgtgccaactggggaccgaagaatgcggcgtacgctccggctgtactgggcggcgaggctgccccggctgtggctccgcagggcgcggccagtcagggcggcatcagtgccgcttgggccggtgcaggaaacatgaccacgcagacgtggagcggggcgagcatccccgcagcatggcgtggggatgccatcgaaggcgcgggcagcggtctcgcccgtgcgacgaaggagtacatcggcaaggtgcgcgaagggctgggcgaactggcgatgggccagaacgtcatcgccggtggcaccgccgagcagggcgtggctgcggcgcaggccgtgcgcggtagcgacgaggtggtcccgtggtgggtgcgacaagaagtctctgccatcgacacgcagagcaacgagcgcaacactcgcgctgccatcgctgccacccagtccgaccgggacgaggttgcgttccgtgactcgctgtcgttcctcgacaagtggggcgcggcgttcgatagcggcatcggtgctgccttgaccaaccagctcagccgtgaccgcgaggtgacgccggaaggttggacgtacgacccgaagcagtgggagaagtcctactacaccgccgacgagctggaggacatccgcgatgcggcatactccccggacgaactgtcgtacgtgacggatcgcatctacatgcgccgccacagcatgcgcatcaaggagaaccagaccggctggggcagcttcggctacgacctcgtggcgggcctgaccgatccgggtaactgggcgactggcggcttggcctccggtggtgtgcgcgcgctgggcgtcggctctgcggctctgttcgctgaaggccgtgtggctgcgggcatcgcttcgagtgtcgccgagaacgccgccgcgtccgtcatcacggatgcagcactggtgggcatgggcgagaaccgcaccgtcgccgacttcatgaccgacgccgccttctcggctggtatcggcacggcgatgaacctgcgcggtatccgtagcgcggctgctgtccgcgacaaggccaccatcgacttggcctccggcaacgccgccatgtacggcgagcagtggaatgcggacctccgcgcacgcgccgtggctgaggtgggcgagggcaacccggtggcgctcaacgcgaagattcactccctcgcgcgagccgaggtgatggactggattcgtgcaggcatggctgacgtaccggacgacttccgcctgttcgctcgcccggacgtggcgcaggaagcctcggctgcctcgaacgctaccggcgcactggcgcgtgacgtggagaacgtggacccgagcaccggcaactacgccgacaacgtgggcgggcgcgtggagtggaacgctccggccgatccgctgctgacccgtgcgtggaaggcgagcggtatcaagggcacgcccgatgacattctgcgttacctcgaatcctcgaagaacgtgccggaagacttccgtgcaatcgccaacacgctgaagcgtagcggtcggttgaatggtgtccgcatcgctcctgacgccgagctggctcagtggttcccgaaccagccgaacgtggccggtgggtacaacccgtcgctcaacgcgatggcgatgcgtagctctgcgcacaacgccgaggtggtgctgcacgaaatgctacacgccgcaaccttccgctcgctgcggcaggatgcgaacttcaaggcgcagatggacgagctgctgacgcacgtcaatgccaacctgtccgaggcggaccgcaacctgatgactcaggcgatgcagggccgggtggatcagcagcgcatgggcttcctcgccaacaccgacgagctggtgtcgtatggtctgaccaaccgcgacgtgcaggcagtgctgcgcaacatcagcgctcctccgggcgcaacgcagcagaccgcgtgggaatggctgaaggacaagatcgcccgcgtactgggcctgaccggacaggagtctgcgttggagcgcctgatgaacgtggtcggtgagaacttgggtgaggagattcgctctccgcaggctgcctcgcagcagacccgtggcatgctggtcaactcgatcttcaagaacaaccgcgagcgcaaggctttcatgcagcgcaccgggctggacaagcagatcagcgacagcgccacccgaatccaagtcgccgaggtgatcggccgcgccgagcgcttcagtggcaagtatgccatcgacgcggagaagctgtccaccatcatgcagaagttcgggctggaggcgacgagcaccacgctcatgtcgtcgcagtccccggtcgctcgcatgatcgccgtcaccctgctggagaacccggaaggcgcggctggtcggcatagcaccgcagcgatggatcgccgcggtcgcttcgagtcgttcatgggttcgcgcccgcgtcagtgggaagcggcctaccggctgtggcgcgccgacgtgcgcaaggctggtgcgatcaaggacttcgccaccggctggaagatgcggagcgagttcgagtacgaggtgaagctgtaccgcgagaccatgtatatgggccgcgagattgccgacgcgcacgagtccatcaagcagatggcgaaggcgctggacgaaggctacaaccggatggctgccgagcagcgcgctgtcggtacggtgggttcttcccgccttcccgatggtgacgtggccggttacgagtcccgcacttggctgggcggcaagattgctgcggctgggcgcgtgcgccgtgagagcatccggcaggcactgcgtgaccagttcgatgtgatgggcgagctgtacggggacaagttcctcgacgacctgagcatcaagtatctggagcggatcgaggagcgggctgcgggcatgaaccgtgcgccggacaacctgttctccgataaccagtctgacactctgcgggacaccctgcgcgcactgtcgctcaacgaggaggaaatccagaaggtgatgggccgctactcgcgtggcggtgcgaagcacaccaagagccgtatcgacttggacgtgacgcgcaagtacaaggatgccgagggcgagttccgcctgatggactacttggacaaccgcgtgatggacaactaccgcaagtacgcgggtcgtgtggctggtgacatcgctctggcgaagcacggcatcatgggcgacgccggtatctcggtgctgcgcaaggccatgcaggttactggtgccaacgacgtggagctgcgtgcgttcgatcaggtgatgtccgagttcacgggccgtgttatcggcacgggcgatccgactgttctggcgaatgcgcggctgctgacctcggctatccagctgggcggagcgggcatcaaccaagcggcggaatactccaacggtctcccggctgtcggcgctgctggcgtggcggaagccatccgaatcgctcctcgcatgcgtgcggaaatcggcaagctgctgcgcggcgaagacccggagaacagcatcctcggcggcttcgagttcatcagcggacgcggcttcggccttgcgggttacgacctgcacatgttcaactcgatggacacgcaggcttcgctgtacggctccgagcgcgcaggcttcctgaccgctctggcccagcgcactgccaacgccaaccgcatcctctcgggacagcgcgcggtactggctgtgcagcagcgcggcttcgcggaggtgctgatcgccaagggtgtgaagttcctgcgggacggcaaggctgccgatactgccctgaaggacatgggcctcgacgacacgctgcttgctcgcctgcggcagacgcaggatcaggtggtgcgctggggcgcggacggtaagctggaggctgtggacccgcgtggtctggagaacctgcacgaccggcaggcgtggctcgcgttctacaacgccatcgaccgtggtacgaaccaaatcttgcaggacaccttcatcggtgagaccggcaagtgggcgcacaacggttggctgaagatgctgttccagcaccgcacgttctcgctggtcgcacagcagaagcagctgggtcgctacatgggcctgtacggcgcatggggtactgccggtatcatcgcttcggcgatggccgtggttgccccgctgcaagccctgcgtgtggcttcgcgtgctgtcctcctgccggaggagcagcgcgagcaggctatcgaggatgcactgtcgcctctggcgatgggccgcagcaccatgaactacatcagcgcaacggccttcctcggcgacgtgctggaagtggggacgggtgtggcgggtggctggtacgagcacgcaaccgacaccggctccccggactgggtgcggcagctcgcgggcggtcagctcggcaaccggaaggaaatcgtaggtggcagcttcgccccggcgctaggggtcatcaacgacttcgcgcagggcgtgagcgggcgtcccgagaaccttgccgacgtgctgccgggcggacgcctgccgtacgtgatcccgctgctgaagggcgcggcggcgcatctggaggaataacgctggcgggccaaggacggcccgacttttggtacacatacgacaaacacaggaggcagcatggcagttcccgatccccagctgcgctacgcgacggacgtattcgacgccaatggcgtcactaccgactggcaaatcagcttcacgggcggctacatcgacccgtcccacgtgtacgcgatgagcggcattctggacgaggaaacgcagctgcttaccgaccggacctctcacaccgtggaggtgctgtccgaggatgagaactcctcgaccgtgcgagttgagcctgccgtcgcggctgggcgcaagctctacatctaccgcagcactccggtgcagcagatgctcgttgactacgttaacggtagcatcatcagcaagaccaaccttaacctaagcaacgaccagttgctgaagatcattcaggaaatgttcgattcgttgaacatcgccacccttagcattgaccagcaagtcggcgtggtggtggacctgaacaagatcatcaccgagatttacaaggaagtcctcgaacttctggccgctggcggtatcgtgtccgtagcccctcgcgtctggtccggctcttggactggcgatcaggcggacgacaccgacttcgacatggtgggcgcggacgtatccggcgcgggcttctacgacgtgtacgtcaacggtatcggcatgcagccggacgtggactatcaggtcacgctcgctgacggaaccgatcccagcttcatccgcttcgccacggttcccgctgagggaagcatctggttcgccgtgctgcgcggttacgccaagccctacaccgggcctgcgccgatcaccgctacgagcctgcgggtgccgatcatcccggcagagggtccgacctactacgccgacaaggctaccgagtacggactcgtgcgctgcacgtacgccgggggctgcaccgtcaacatcaacctgatccccgaggtcggcgacggtgagacgaagctcgcctcggggagctacttcagcgtgcagcagaaggcaggcccggtggtcatcaccggcgacgcgggcgtaactctcgaagtaccagccggctgcatcgccgcaactcgcggcaccaactccgtcgtcactgcaacgtgcatcgacggcgacaccaacacatggttgctctcgggcgacttggctaaggagtaggcatggctaatcacttcaggctgtacggccgaccgctgatggcggacgaggttgcagatggcctgtcggtgacgggcgtgctggaagggtacacggcgggcgaggcttacgagtctcgcctgtccatcaacaacccagtcggccgctgcaccgtggaggtcatcgaatcgacgctccctccgggcgctgcggtacgagtggacaatatcaccaaggaagtcgtcgtcaagtgggcggctttcactgaagtcgtggacgaggaaaccctcgtgccaaacggcgacttcgaggcaggcgacgacggcacgtgggtgccgggcggcgggtcgaacggcgaaggctggtcgattggcaccggccaggactacgataccgacagcggcgtatacagcgcgcgcttcgccgacatcaagacgggtggcagcgacctgctgaacccgctgattcctgccaaggtcaacgactacatccgatgcaccgccgaggtccagcagggcgcaagctccaagggcaaggccggtgcgcgcgtgtcgctcatctaccgcaaggaggatgggaccgagctgcaacgcaactggggcaacatggtttcctccggcagcaacggcgcatggcaccagtctgtcgccgagggcgcagcgcccaaggacacgaagtacgtgcaggtggtcctgtccgcattccgcagcaagcagaacaagccgctgtgggtagacaccgttaagtggaaccacaagtacgtgctgggtcagaacgacgacagctcctacttcctgagcatcaaggtcacggacgggttgaaccgtgtggcctactggtccgggcgaatcgaggagcagggcatctacgttacgtcgaagctctacagcttctaccagttcgacgccgcgatgcttaccagcagtttcgctggttacagcaacatcgacatgctaccgcctgttgattccgccggtattggttcgtcgttcgtgggctgggaacttcgcagctctcggcaggactacacggccgatccagaatcggcgctgtacggaagctcgttcgtctcgttcgacatccggtccatccgtaaggactacacatcggacccggagacggctcgggtgtccagttccttccattctttcaccctgaagcagcaccccgtagtcaatcagccgctcgacgcgactgccttgattcggagcggcttcgtctcatggagcttcgcatgatccacaacaaagtgggagtagccggcctgttcactatcagcaagggcaagtctctcgactcgctcgaagtagtggcggactggcagaacaacctgattaccgataccggcatggacgcgtttggcgaccaaggcagcggctacgcgcagagactctacaacgtcatcagctaccttgcagttggtagcggaagcaccgagcctgcgttcactgacaccgcactcgctgcacaggtagcgcaggtgggccgcaccagttacgagactggcggcacgtccaccgctccgtactacgcctacgcacgagtgcagttccagttcccggcaggcactgccaccggcgtattgtcagagcttgggggtaagtggtacaacagcaacaacggcacttacccgcttacgactcgcgcgcttatcaaggactcctccggcaacccgaccaccatcacggtgctgtcggacgagattctcgtggtcacctacgagctgcggatgtatgtggacactacgccggtcgtcactaccgagacgattaagggcgtcagcaccactgtgacatgcaagcccatcgctctcgggcgcagtggctcgctcaacgagcagtctgctattgcgtggtcggattacgtgtggggctgctactacttctacggaggcaccggcgacggtactggcgcgatcacggatcagtaccctccgggtaacatgtccagctttagcgatctgcaaatccagtacgttgcctacgtgcccggcacgtactaccgcgatgtggtgtgccgtatgtcgatcaacaacgtaccacccggcccgatcactgcggctatgggccttagttcgtgcgtgccgttccaagtcggcttcaatccgggcgtcacgaagaccggatcggaaacggcgaacctgcgcatgcgcgtttcgtggagtcgctacacgccatgatccctactgtctcccaaagcatccaacgtggtgactgggtagagcagcagaaccggcgcacccgcccgctcatcgacttcgagcagggcgggctgactctcaacgcggcagtggacaacctccaagctgcgctgtggaccgccgagagtgatggcagcagcgtcgtcgtttaccgcgacggcgttgcccccgtcaccgtgctgaccgactcagggatcacgcagatcgcactggcctttgaccagaccatgcgcccgcacgtggcgtacatggcgggcggcgtgtgtaagttctactggtatgacacggtggctgcttcgatgcagactatggtgatccccggtgctaccaccccgcgcctgtgcatggacgagaagcgagcggtattcgccacgcagagcgacgtgctcctgtcgtacaagaacggcagcaacctgtgcgtacgcgcgcagcgtgagcgcttcgcaaccgaacacgtgatcgcctcgggaatccccggcgacctgatcgcggtaggcatgaacaacgtcaaccgcctgcaatggaagctcgtcggcaatcccgacgactggccctaacctataggagaacataatgaccccgccgtcactggcttctgaggtcgtccgcacctcgcccctcacggcgggggcgttgtacctcaacttcatcagcacctatggcgcagccatcgtcaccacgctcgccatcctgtacgccatcgcacagttctactggcgcgcacgcgaacaccgcaagatcatgggagacaagaatggcgaatcccgcaagtgaaggcgcgctcggcgagctgcacgtcatcgtcgcaacggtcctgaaggagcggctgcgcaacgatgagctgtgtaccgctgccgacatcaacgccgcgatcaagttcctgaaggacaacaacatccaagccacgcgcgaggccaacaaggcgctcgacgagttggccgatacgctggagaacaaggacgtgtccgaggccgaggaggccgagctgcaagcagcgctggacaacatcgttaactttccggggagcgtagccaatggcgcatgagtccgcagaggcggccgagctgcgccgcaagaaactggctgtgctccagaagcactacgcgcacttcgccgtcttcatgcgcgacatcatgaaggtgctgggcttcacacccacgtggatgcagtacgacatcgccaactacctgcaattcgggccgaacaacctgatggtgcaggcgcagcgcggcgaggcgaagaccacgatcaccgcgatcttcgctgtgtggcagctgatccaagacccgcagcaccgaatcctcgtgatttcggcgggcggcaccaacgccaacgagacggcgacgctgatccagcgcatcatcctgaccgtgccgcagctcgaatgccttcgccctgacaagaacgcgggcgaccgcacctcggtcgaggcgttcgacgtgcatcacagcctgaagggcatcgaccgctcgccctccgtggcgtgcatcggcgtcaccggcaacctgcccggcaagcgcgcggaccttctgatcgccgacgacgtagaatccaacaagaacagccgcactgccgcgaaccgcgagctgctgctgaacatcacgctggagttctccgccatttgtactggtcgtccgggaatcccggcacgcatcctgtacctcggcacgccgcagaccagcgagagcatctacaacacgctccccggtcgtggcttcgacgttcgcatctggcccggccgctacccgaccccggcacagcgtgaggcgtacggcccacatctggccccgtccatcgtgcagcgcctcgaagcagacccatccctcgcctttggcggtggcccgatgggcgacgaggggcagccgaccgacgagcagatttacgacgaggccaagctgcaagcgaagctgaaggaccgaggcccgtcctcgttccagctgaactacatgctgaacaccagactcatggacgccatgcgcttcccgctgaagacggagaacctgatcgtgattccgggcggcggaacccgctacccgctgacgatcactcgcggcatgtcccagcagcaccagcgcacgttccagtccagcggcatcggcttcatcatgatggccccgcacgaaatctccgtggagactgcggagcttcagggcgtccacatgcagatcgaccctgccggtggtggtgccaatggagacgagaccgcgttcgcagtgaccggcttcctcaactccaccgtgtacgtgctcgcagtgggcgcggttccgggcggctacgacggggatggcctgcgccacctcgcggaaatcgctgccaagtacaagccgaacgtcctctccatcgagaagaacatgggccacggtgccttcgccaaggtgttcctgccaatcctgcgggagaagtggaacggctcgctggtcgaggagttcgtgaccggcaacaaggaggcccgcatcataggaaccttggagcctgtgatcgcccgtggctcgctcgtcgtgctggagagcgtggtcgaaatggatcacgagtacacgcagcggcacgccaacagcggcaagcgctcggtgtattctctgttccaccagctcgccaagatcaccagccaacgcggcagccttgcgcacgatgaccgaatcgacgcgctggagggtagcgtccggcactgggtgagcaagctcgcactggaccagaacaaggccatcgagaagcaagcgcagaaggagttccaagactggatcaacgatccaaccggcatgaaggcggcgacccgacgagggccgatccgtgcaggccgtccatccatccttgaccgttaccggaggtaacatgctgaagtccgatttctccaactacaccggcctgttcggccgtggcaactacctcgtccgtgagctgctggctctggtcgagcatgccgagaagcacccgcagactgcggcccagctgggcaccctgttcagcgccgacgtggcgcgcgtgcaggctgccatcaccgctgcccagtcccgtgcggaatcgtccggccccggtggcggcgcgctgccgaccgaacccgagccggacccggagggctgaccatgaacgtcagcaagcgcgtcatggccgcgctgctggccctcgcagtggcgggaggtggggcaacctacctctcgctcgacggggcgcagcagatcgcttcccatgaaggctaccggctggtggcctaccctgacccggccactggcggcgcgccgtggaccatctgccggggccataccaagggcgtgtatcgcggcatgcgggccacgcacgagcagtgcgaccagtggtatgccgaagacctccgcgtggcggagcgggctgtccagcgcaacgtgcgcgttcccctgaagcaaggggagtacgacgcgatggtgtccttcgtcttcaacgtgggtgaaccgaatctccgggcatcgaccctgcttcgcaaggtcaacgccggagaccgccgtgggagctgcaaccagtatccccggtggatttacgccaacaagatggtactgaacggccttgtgacccgacggtacgaggagcaggccatgtgcctgaaggacggaccttatgtctatcttccgtaaaatcgagttgctgatcggagggctgctgcttgcggccgtaatcctcctgtccgcgtactcgctgcacctccgcaactcccgagccaacgtccagcaggactaccagcaggcgtcgggcaacgcctcggccgctaccactgcggctaaggaactcaaaaccgtagtaatcgagaaggagaacgcgcatgccgcgctcgatcaagcccttgcccgcagtcctgagtgggctgacgagcctgttcctgctgatgtcgctgacctcctgcgtcacgataccggctccgcccgcgcagtaccttgaagattgcgccgtaacgtacctcaccaaggagaatccgtcaaactccgacgtagcgaagctcgctatcgaccgagagttcgacgttaagctctgcaacgtggacaagcgcgccctgcgtgcgtggtacgacggctacaagcaagcctgcggttggcgctgcaaggtggagaagtaggcatgacgaccattgtgtgggacggcaagcacctgtatgccgacagccaagtcactgcggacgacatgaagggcacgatgaccaaggctctccgggtccaaaccccggagggtccggtcttctgcgccgtagccggtgagattcacgtcctccgctccgttgtagccgccctcaaaggcggagaagccatcgagccgctggtcagtggtagctccaccgtgcttatcatcaaggacggacaggcgacagtcgttagcggtaagaagtcttggcctgatgacgctccgatcttcattggcagcggcgcgggtattgctcgtggagcgtaccatgtgagcaagtctgcggctaaggccgtggctgccgcgtgcgctatcgacatgtactccgctgcgcccatcgttaggcttaagacgggctgatcgggagctggaccaaattttgatttagaattgcgcgggggccactccaatcaaagctcgcgtgtgcgcccccatgcgccctcccgcgtgacgcgcgtgggtgcgtgcgggtgtatgcgcgcgtgcgcctgtgggtgcctgtgcgtgcgcgtgcgtgggcgttacgcgggcgcgtgttcctctctcctctcgcgtggaggtgtgctggtcaggtagtacaccggcgcactggtgaggcaggacagcagctcacgcaaggcggctggatttgttcagctacggttcagaatgggtgtgcgatgatggctccacgttggaagcacgggccgcacattggatgcaggccacggggccaccagcgggcctacagggcgcacgcagggcttgacaggggcaaccctaccgggctatgatgcggacgcactgagggacgggagggcggcatctgtatcgttttccttttggtacacatacgacagagggcatgtcctgaaaatcgtatcggtctttagccggaagtgaaccaaggggttgacagatagcctagctatagactagcatcctccctgcggtcgccgatgcaagccacacggcaagcattgacagccaagagggttgacagacggttagcatagtggtaagctagtggtcagtcgagtaacaagctatgagcaagccgctgggacgccttcgggcagacgacaagggcaagcggccttagctactggtaggattatgcgaggagctaccctaccgggcttgacaggaagccaagagtaagctactatgcaccaacggtcaggaagcctaaaggcggagcgactactagcggactaccggcttacatggtaggatggtggcgacaggacgcccagtcgagacaatagggcttgacaagatgcaaacggtgcgct

SEQ ID NO: 22 - DNA, 43869 bp, Unknown
  Bacteriophage Xfas304
ccttaacatccgatgcggtagtctacacccatcgcagcaatgcaccgcagcgacaccgttacaacctcgtgcctaggcgtagcagcgtgcctatgatgggcgagggagaccaccggggtacctacacagggccggagggtcggcggggcaggaacgcacgctgagcgcgtgtgagcggcatctgtatcattttgctggacatgtaacacacgggtagcgcactggtgtactacctgagtaacacaccgatacacgatttggtacacgtacaacagatagaccgccgtattgcaaccatcctcttgacactggggggacaaggcccgcacactcactcctagaacggagtcattgtgggtagcgatacggacccttagatgggaacggactagctgggcttacagtgccatccgcttatctgcacttgatgttccaacgtagttggcgagtcgtagataggagttgacgacttaccacccggtaagtgttgacaggtagcttaggacgtgtcaccatagcttcgcagtagttagacaggtgggcttagacagacacttgacaggagtgagacagtaggctagtatgagtctcacatggttaagcaccgcagcgaatcgcagcgcttggcacatgaagaagaatgtattagcctattgacaacgacttgcgagtcaggcacactggatgccaacaaggtagcttacacctaccggaagagtagatgactgcatagcttagggctgatagctcaacgcatgcacactgcttgaccaacgagtaagcacaacgccgatgacgtaattgaatgtggcttagtaaaccacagggaccagactagagtaccgcaaggtatgataggatgcggcgtagctcagagatgagcactcactatctgcggtggaagcccgccacggtgagtaagctagtgtagtgctagcaggtgcgtcaaagaggatagcaagggtgggagtcataccatctgcgcgacaagcagcccgataggttgcttcccacctgagccggtggcttgggtctaatagattcacccgaatgtataggtgccttgtgcatctatatttttgggttgaatcacaagggtcttaacgctaaggctcttgccattcaacctaatgagactaaggccatgacctttaagcagcgcatcttcagcttccgcaagagccgcgttgtccttgacctgcgcaccgatgctcaggcccagcgcattgcggacatcaagcgcaaggctcagcggtatgagaccctgaagcacaccgcaggcaagccctccgtctttcccgctccggctccgatgggctgggagttggtggaggcgtgatcgctgtcatcgcagttgcattcctagtcggcttctctgtgggagtcggctccatgctgtacctacaccggagacacacatgaataccaatcagatcgagcgcaacatcaaggccatctcccgcttcggcaagaagatggatgccttcattcaggacacggcgttgcaggtggcgttgcactgccacaagcacggggaaatctccctgctgcataagctgtggtcggcgatgcaggagttcaagggcgcacgccacaaggcgatggacgagtggatgatccgcttcgccccggtcaagatggtggacccggcgaacatcccggatgacaagttcccgttcaccgtggacaccgagcgcatgctcgatgaagaggggcgcaatgcgctgtgtctggaacaggccaagcccgcgaaccactggtataacatgaagccggaccccaagctggtggattcgctggacatcaacgccatgctgaatgcgctgctgaagcgcgtggacaacgagaccaagaagaatgcggacctgaagatcaccggcgaggataccctgcgcaagctgcgtgaactcgtcacccacatggagtaggccatggacaacgtagatctggtcgaacagttcggctgcggtaatgtggagagtgcgctcatcgtggcgcactacgtgcgggactacgtcgaggcagaactcgcgaaggacggaggcgtgcgcatctcaaccacagggatatgtgacctctggtctgagttcgccgactcgattggggctgccaatcggtggacccgaaaggcgagggacacgctgtaccacgagtggccgcacttcagcggcgaccgtctgtatccggtgccgtgtccgctgtccatgatcgacgcctatgaagagtacatcctctcgcaccgcaacccaagtaccgcgatgggcaaggaggagttcgctttcaaccgcgcgccgcacatgtgggatggggagtacggggagagccgcatggcgtgcctcgtgtacatcatcgacaggctggaggctgcactcaagtaatgcccgtgcccttcgcaagaggggccacggagatacacgcaaagtgggttcgagtccctaccgctcccgagttgtaaccggagcggcatcgcaggcatgcggcgtgtatctccgtgcgactggcacgctaaccgattcaccaccatggcaatcatcgtgaagtacaagaagaaccgcatcaccaagaccaacggcatcactgcgtggcgtgaggaccgcacgttctccgtcgaggtgaaccgcatggaccgtgcgatgggctgcgcttgcatccgcgaagagttctattcctacatgggagtgcgccatggctaagtacaaaggcaggtatcgtgagcttgcccgtaggctggacaggctgatcgagaccggagcaatccggttgttcgccgagcgccacacccgtgggcagatcgacggcgaggagttcatcggtacgtaccttgccgggggcttcaggctcgtcggctatgggtactactcccaggtgttcagccactggcgtgcgccgggtgtcgtgttcaagtacacgttcgatgattcggactgcatgctgtatgtagcccgagcattcatggaactgatgcacgagaacctgcccgaggtgcacatgatccactcggttgaggtggaggagactaccgagtacggaacgcgagtggtgcggacgcacggtgtggttgtggccgagcgcttgctcgcatgtccagaaggtctgacttctcgggagatgcgcgagcttcagagggaggcagagcgcgcggtggccgacccactggacgagtaccgcatccgcctctcggacatgcactccggcaacatcatgtggcgcggtgatacctgcgttatcaatgaccccaccacttacgtgaggaagaaatgaaacactacgactatgcgcacgagggcaagagctatgaagaactaccccatccaatcgtacgccgccgagattcaggcgctcgccgagcgtgtggtgtcgagcgccgggagcgccacgctgcacgaaaggcagggcaggaactgcggagggccaagcggagtggtgcacagtaacgtccgcctgcgcaaggttctcgaacgcacccacgttaagacgggtgaggtaactcgcttcgtctatgatccagacgtgaaggtagagcattggatcggcaacaccctagtaacaagcgacgagaacatattcgaccccgagcattatcggaggtcggtgttccatgtcttcacactaaccgaagaggagtacgaccgtgagcaataccaccgcgaaccgtaagcaatacgtcatcgcctacggcattgacgacatcctgcaccataacggggtgaactcggaacccgttcgccttctgcccgaggggctgaagaagttcatcgatgccatcaacagcgcggacctgcggcgcatgctgagcccggccgaccaggcgagtcgcaccgaggtgaccaaggcgtggtcgcaacagcagtaccttctggttacccggcgtgctgcggcccgtcgcatcgtccagatcctcaaggctgccggttaccactgccgtgatgacttccgcctgatcgaggtgggcagcacgccgcgagaggtgaagcccgtcaagcactggaacatcgagcggcgctacaggtacgtgtatctgatcggcggccgcaaggaaccgtggtccgatccggaaacctgggaccgtggtatcgccacccgtgcaaacgcacgagagcaggccgaacttcgaacccgcgaaacgaacgcacggtcggaagactatgagtacaagttcactgccgtgccggtgtacgcatgagcatcctgtcctgggcaaagcgtaagttcggcgtcgtgcgtgactggctgttggatcgcaaccccaagcacgaagacctccacccgtgggatcaagtggtggcggcgttcgccaaaccgcagcgcctgcggggccacggctacgtgcagggcgagacgttcgacatcggcatcaatcgtgccaagcgtgcgatcaagtccatcaagaacaagcgcgagcgcaaggcggcacgcactcgcttcatccaacggctgcgtgacagcggcatcaagtaaggagtaacacgaatggcccgtgactacggcaactacattcgcatcgccattccggaggccaaggtaaaggtcgaggcggtgcacaacgcactggtcaagctgatacaggcggccggtggatcgactgccgtcgaaggctggggaagctgggtcgatggcaatggtggactggtcaccgagaaggttatccagtacacctggaacttccactccaccacctacatcaaggtggacatggccgcgcgtgagctggtgaacgcgctgttccgtgcgggtgagcaggccgtgctgaaggaacgctactacgacgagagcattgcggtgcacacccgcactctcatcgggtacgctgcccgcatgctgtacgcaccgaccaagcactgagctaggtactaacatgcagctaatcagagacggcccggtgtaagccaacccacacataggacagagtcgtgacgccaacacatcaaatggcacacctgctcggagcctgaccgagagacaacaacaggcaaccaatcctacctagcacaaggaacaacacacatgacgaacaacatccgcaccgccgccgacatcaccgcccagatcgacagcatcaacgccgccgccgagagcggtaccccggccgacggtggcttcctcaccgtgctgtccctcgaactgaaggcgcgcaacgccatcgagaagttcgagaaggcgaccgccgaatacgaagcgcaggccgccgtgcgtgacgtgaagcagggcgacgccgtgtcgctggtcttcggccgcgccgccaacaagcaggtgctgtcgggcaacgtgctgagcatcgagtcccagcccaccggcctgctgttcaccgtgctgaccggctcgggtgccaagtccaaggtcgtcaacgtcggcgccgacgcgctgctgctgtcgccggaagccgtggccgccgccgaagaaagcatcctcgtcgccaagctggaagccgagcaggccgccaaggacaagggcgagggcaagtcggagtaatactccggcgtgagtaagtgcggtgtcctctcgaaagagagggcactgcgatgcacactgcactaaggaaccgggcacgctgcccgaggtcgtccgaaggtggtgtcctcacagtccagcgggtagctcccgactgagtgtgcatcgcagtgcactccgcactatcaaggagaagacaatgagcaagcagttcaagcagtacatcatgcacgccctggataccgatggcgaactgaagccgatcggtgtgttcacctatccggcgggaaccagcgacaagcaggtgaaggctgcggtcagttccaaggtgaaccgtgcgccggagaacctgttcatctcggacaccacgctggtggagttacgctaatgcacgaggtgcttcacttcctcgccaacgtggggcttgggttggtcgtgctgagcctaatgttcatggcactatcgaacctgcgcatcgcagtggatgctccggctatcgtcggccgagtgaaggactctttcattgcaggggactggccatgcccgctagtgtacgagtacctgacacgccaacgggctgcgcgccttggctggtacgggcgcactgtgcagcgcgagtgcatcctcgccaacctgttcttcgtggtcggcgggcttgcgctgtggccggacatcctgatccacctgtggtacgcggcaagctaagccgtgctgtacgccttcctgtacgtggataaggatggcgtgaagtctgagcggcaggtcaacgttgacaccataggcgctgatcatgtgacaggtactgccggggccgacgctcccggcgtaccttccgcaaagatcgcatcgtccgccacgagatggtaattgtagagtcaggtgagatacttgatgtgatgacaggggaactaagatgagtcgcctcgccgatgacgagtggttgccgcaggcacatcgcctgctgataggcggtcgcaactcagcgcgcggcgaccatgactgtggtgcacccggctccctcatgctgacccgtgacggagcaacactcacagcctactgcttccgatgcggtggcgtaggcaagcatatgacgcaggagaatcccaaggaaaagttcgagaggttgcagcggcaggcaatggctgacgagttcctgcgcacagcagtggacccgcccgagccgacgacgtacaacccggccaagtggcccgagcgggatgcgttatggttctatcgaatgggactctctccccgcaggatcaaagaactagggctgtactacaacgccgagtccggacgtgtggtactaccgatccgcgaggatgaccaagtagttttctggatggcacgctcgcagacagccaagccaaagtggattggcccgcgagttaagaagcgtggtttgtttgccaagttcggaaggggactaggcagccacgttgtgctgaccgaagacccgctaagcgcatacaaggtgggcttagtgtgcgaggcttggtcactgctcgggacgaaggtgcacagtcgccacgtcctgcaactgatggagttagggaagccggtagtggtgtggttggatgacgaccacgaccattactccgggcgtaacccagggcagatagcagcccgacaagtgatcgatgtgctgagaggtgcgggcctgaatgtgcagaacatgactagtccacgcgaccccaagtattacaatcaataccaactgaaggagatgatgaaatgctttacgaacgtaacgtagttggttccatggtcggcgcagtcgccaaccgcatgctgaaggactgcgacggtgtcgtcatcgcgaaggccaagactccgaccggtcgctataccggtgcgttccatgtgcaggctctcggggaggcgcccgacgcacgcatcccgaagtacaccatcgctactatctgcccgccgagtacgtacccgaagtggccgaagcagtacgcggtgaagcgcaccgagtacggcggtcgggtcaccaccgttgctcgcttcagcaaggaggcggacgccaacgagtacctgaagctgcgcaacgagcgcgcgcacaccgaggtcaaggatcgctacaagatggagcgccgtggtccatggctctgcatcatcgacgccgaggcaccggcggccaagttcgccatcgccaagttcgcgagcagccacgaggtgacggcggctgccttcctgcaacgcctgaaccgggggtaatagatggagcgcagcgagcacaccttgctgcgcctcgggttggatcgcaagacccacaccaagctgttcgacattatccccaagtctgcactgaccgggaatgtcttcacgctttgggaggcgcagcgtaagttctacagcaagttcaacacggacaagatcaccgacatacctgcgtggctgacgtggttggaggatcatcagttcgcgaacatgactgacccggatgcaaaggaactgctgcttaccatcgcagggaagctgaagcacgggccggttgatgaggcaatgatccccgctctcgctaatggttacatccagacggcgctgagcatggaggtcatggacatccttgagaagttccaagatccggataacgaggaagacctggacgtgatgttggctggtgccaacgacaagtacaagttgctcatcgagcgcacggtgcactctcccatcgagaacaccagcttcgatgacctgtacgcccaggacgaaacggactatggattccagtggcggctgcccgagttgcggcagcacatgcgccgcgttcgcgcgggtgatgccatcgtctgggctgcccgtcctgatcgtggcaagaccacgaccatcgcgagtgagatgtccttcatgatcccgcagcttgacctcgtgtatccggatcagaacaagacgttcatctggttcaacaacgagggcgacagcaagggcatccgtcggcgtttgtatcaggcaatcctcggtgtgccgcagtcgcagatgatggcgtggcacaaggatggtacgttgctgaacaggctgcacgaggcgtgcggtggtaagcatctgttcgaccgcatcctcatcatgtccatccacgggtacagttcgggtcaggtcatgcgcctgatcaaggaacacaacccagggctgtgcgtgttcgacatggtggacaacatccggttcaatggtatcagcaccaacggcggtacgcgtacggaccagatgctggaagagatgtacaagtgggtgcgtgatgctgcgatcatcgagggcttcgctgccttcgagacctcgcagatttctggtgacggtgagaacgtacagtacccgctgatgtcgatgctgaaggacagcaagacaggcaagcagggtgcgtgcgatgccatcgttatgtggggcgagcagtccggcaacgagcgcggccgcttcctcggtatcccgaagaacaagttggttgtcgaagggcagccgatgaatcctaagaaggagtgctacttcatgccggagattgcacgcatcgtttcattcgacgaagtcaacgaggagtgagtatgaactacgagaacctgacgcaagcccgccaccaagcggagcgagtgctgacccacatcaccctgcatcggcaggctgtccgccacgggctggtcgcaaagccggacgtgtcgtaccgtgcgttgcacgagtgggccgagagcctgaagaacatccagtccctggtcacggtcaagcgcgccgcgcgcaccacggtcaagctgctgttcaatgcccgcagactgtgggtgggcgtgcactactcgcctgcgaaccgccgctggtgcgtcaacctgctgcccggcgtcaccatctgcatcaccaaggcgggaggcgtcgagccgtgatcactgcggagagggagcttaaggttcatggtaagccacacatccgcaagcgggatgggatgtgggtgtacgagccgcgagcggaccgccgtacttccttctggcctgcgaactatgcggcgatgcgctggtgtctccacatgaacggaggttagcatgagcaagtacatcgcgtgggacatcgagacggggatcaagcgtgcgctgaagcgcaaggctaccccgttctatggtgtgaaccaagtgtgggccgtgggctatcgcggctccggtgtggtggacaaggtgggattccaccgtggagttggcgggatacctgacgactacttcgccgacatgctggataagtgcaagatcctcgtcgggttcaacatcaagttcgacatgctacacacgctgcaagatccgaagaactacgccgcgtacaagcggtgggttgtcggcggcggcatgctgtgggactgtcagcttgccgagtatctgatcgagggcatggacaagaagtggcacatgcccagcatggacgaggtggctccgaagtacggcggcaacctgaaggacgatgcgatcaaggcttgctggaacaacggcatcgacacaccggacatcgaccccgacatgctgatggattacctgatgggcaccgatgagccgggagacctcggtgacatcggcaacaccgaagtgatcttcaagggtcagcttgaggtgctgcgtgcacggggcggcatcaagtccgcgatgctcaacatgggcggcctgatgtataccatcgaggcggaactcaacggcatgaagattgccgaggagcgagccgaagagttgcgcgtcgcgctgctcgctgagctagaggcagtgaccaagcgcgtcgctgagtacataccagcggatttgcccttcgagttctcgtggtcgtctcgcttccacaagtcggcgctgctgttcggaggcgacatcaagtacaagaagcgcgtgcacaaggaggatgaccagggcaacaagctgtactccatgcgcgacgaggtgcgctacctgtgcaaggacggcagcactgcgaccgagcaggagctggactcctgggatgacgcgtggtccaaggtcgagcggtacgctggtggtgcgaaggccgggcagcccaagacgaagaaggtcaaggttcctgacctcgacaagccgaagatgacaaccgaggatttctactaccacttcgatgggttcgttgagccattgaagtcttgggccagtagcgccgagggcgtgtactccacggcgagcgaggtgatcgagactctgggtacgtgggaagatgcgcccccgttcatcaaggactacgccaagcaggcgaagatcgccaaggacttgtcaacctactactgggttgaggatgaggacggcgagcgcaagggaatgctgtctctgctgggaccggacggcatcatccatcatcaactcaacatggtcaacacggtgacggcccgcttgtcttcgagcgatccaaacttgcagaacattccgaagggtgacaagtccgatgtcaagacggtgttcatctcccgcttcaagggaggcagcatcgtgcagtcggacttcacctcgctggaagtgtacgtgcaggcgaacctgtcgcgagacaagaacctcatcgccgacctaaagacgggcatggacatgcactgcgtgcgcgtagcgcaggcgcacaagctggactatcagttcgtgcttgcgcgtgcgaaggatgagcaccacgaggaacacaagaagtacaaggcgctgcgcaacaaggccaagaacttctcgttccagcgcgcgtatggtgcaggtgctgcggccatcgcagcggccaccggcatgaccgtcgaggaagtcaaggcgctgatcgaggctgaagagactcggtaccccggcatcgtgcggtacaacgacagcaacctgcgcatgctgcagcggaatcgcaagccgtcgtcgctgttcgttcagcatgatgaggtgcgcggactgaccgtgaacctcggcaagtcttatctggaaacgccggacgggaagcggtacgtgctgtgggaatcctgcgcaccgaagttcctgtacgagcgggacggtacgacggtcacgttcaagccgacgaccctgaagaactacccggtgcagggcatgggtggtgagtgggccaaggctgcgatgtggctgctggtccgtgccttctacgagaaggacaactacgacggcaaggcgctgctggtgaatcaggtgcacgatgctgtgtacgcagacgtggcagaggaagtacgcatcgacgctatggcccttatccatgcgtgcatggaggaggcgagcgtgctgatggagtaccagttcgattggaagatcgccgttcctgtgccgactgagaccgtgtacggggcaagcatggccgaggaacatggcgagcctgcgatgcgtgatttggtacacgtataccggaagcacattcgcgaccgctacatcaagggatacgtcccatcattcgagaaggaggagtagcacaatggcactcaacgcagcaatgaaggcacgcctggcgaaggccaagcaggtcggccccaacatgaacgaagcgcagcagggcggtggtggctacactcctcccgctgagggcgtgacccgcctacgcctcgtcggttacttcgaggtcggcgaacacacggagcagtccggcaagttcatcggcaagaagaacaagaaggtgcagttggtgtgggaactgagcggcaagaaccacgagcctgccgagcacgagggcaagaagattccgattcggatgacgcaggaactgaactactcgctcaacgagaaggccacgttctacaagttgttcgtggaactgaatgcctgccatggcaacgaggccaccatcttcgccgaactgctgggcaaggagttcatcggcaacgtcgtgcacagcaccaagggcgagggcacggcgaagcgcacgtacgccaacctcaccaagatccgcaaggccgtgcgtctggacgaggacgacaacgaggtgccggtgaaggtggacgatccgatcacagagccgaagttcttcgtgtgggacatcgcgacgatggaagactgggatgccatcttcatcgacggtgagtacccagagcgcaaggacaaggacggcaacgtcatccagaaggcgcgcagcaagaacgtccttcaggacaagatccgcagcgccaacaacttcgacacgctgcccatcgcggagttcattcgtgctggtgtgagtgcgaaggatgaggcggacatggacgaagcgctgggcgacgacgacaacacggacgccgatgccggtgaggacgaggtgcacaccccggccgacggccacgccgatgtcgatgacttggtgtaagccatgaccactgcggccgagcgtctgaaagaacacgcccgcaacgcaccgatgccgggtaccactgcccggccctcggtcgagggcatgccactccacatcgacggtgactacgcggcatactactgcgcaggcaacgacgagacctcacccggcaccgcacggcagaacttgctggatcgcatcgagcgtgcgaagcaggtgtctggtgcaactcgtgccatcgtgcacctgtccgaccgcgcatgcgacaaggggctgcgcttcttcatcgcacagtccaagccgtaccaaggtcagcgcaacacggggcgcaagccccagaactgggactacctgcgcgagtacatggagacctacgagggcgatgccttcgaggttaagaactggatcgaccgcgaggccgacgacggcatggcgtatgtgtccgaggcagcctacaagatcggtaggccgggcgcggtgctgaccgccgacaaggacatgcgaatgttcgccggtctgcacatcgtgtggaagaccttcgagatggtggaggttctgcccggtacctacgacaaggtgcacgacgggaagcagtacgggcacaagtggttctggatgcagatgcttcagggcgacacggcggacaacatcatgggcctgccgcgcgtcggggaagtggcggcagagaagaccctcgaaggcaccacctgcaacgccgaggcgtatccgctggtgctggacatgtaccgctcgaagatgcgcgatgcctacgccgaccacttcgtggagcaggctgcgctgctgtggatgcggaccgacaagagtgcacatgtcaacgactggcgcaagctgatcgaggactggggcaccgacatcgaccgcgccgctgcacggcttctcacccgagtacgggaggagcgcgatgctctctacgcctcgaaggcttaaggcatccgaggttgcaactgtgcgtgcccgcattgctgaagagcagggcgggcgctgcaagttgtgccaaggaaagctgggtaccaaagcaccgctcgaccccgtgcttgaccacgaccatctgacgggagcagttcgcggtgtgctgcaccgtggctgcaactctctgcttggtaaggtcgagaacaacgcactgcgttacggtgtgcatgcactgtccgcgttctgtcatggactggcgccgtacttccaggcccatgtcaccaacatcaccaacctgctccacccgaccttcaagactgcggacgagaagagactcgctcgcaatgcgaaggcgcgtaaggcgcgggccaacaagaaggacactgcatgaatgtcacactgaaacaactcctcaagcgtgcaccgaagcacgggccgaagatcatctgcctggacatcgagacgttccccatcgagttctatggttggcagatgttcaacaacaacttcagcgtgccgcagatcaagcgggactggtcgctgatgtcgttcagcgcggagtggctgcatgacgacggcaacttctacatcgaccagcgccgcgagaaggacgtgttcgatgaccgcaagcaggctgctgcgctgtgggccatcctcgaccacgcagacttcatccttgcacgcaacggcaagaagttcgacctgcgcaagatcaaggcccggctggtgatcctcggcttcccgccgctgtcgccggttggagtcatcgatccgatgctgctgaatcgagtggagttcgcgttcacctcgcacaagctggaatacaccacgggtgtcctcgtgccgaacctgcgcaagtacaaccacggtaagttccccggcttcgagttgtggctcgcctgcatgcagtcgctgcctggggcgtggaacgagtgcgagcagtacaaccgcatcgacgtgaagagtatgaaggaggagtaccttcaggttcgcggctggtactcccagcatccgaacatcgcggtgtactacaaggccgacggcagcacccaccgctgcaacaagtgcgggcacgacgagatgatcccgcaggacaagcccgcatacacacaggtcggcacgtatctgctgctgcaatgcacgcagtgcggtggacacagccgcgcacgccgactcaccaccaccatcgaagagcgcaagcacgtaaccgtgcccgcctaaaggagaacgcatgagccgtatgctggaagcgtatcgtgtacaggtcgtcacgtcgaaggacgtggagaacggtgcaaccaagggcagcatcctgtggctgcacagcgaagtggaagaccagccggggtactactacttcatcaactccccggactccgacgtgggcatcccactcgccgtggcccaggtcacacgcgacgaggactgcaagcgctacgaccgctacctcgtggagaagccgcagcccgcagagccgcagcccacaccggtggaacccaagcccgaggtgaccatcgcccaggagtgggcgtcgaagatcgagccgaacccgcgcggcgcgggcctgaagttcgacgccgggaaggtgcgcccctccctcctgatccgtggcatgccgcgtgcgctcctgcgcgttgcggatgttctgaccttcggtgcgcagaagtacgaggcgcactcctggcgtacggtcgagaacggcgaggagcgctacgatgacgcgaagctgcggcacatgttcgcagacgcgctcggcgagcaggccgaccgcgagtcttccatcgaacacctcgcccacgaaatctgcaacggcctcttcctgttggagaagctgctgatcgagaaggagaacgcacgttgagcaccgcatccaagaacgccgcacgcatcctgaagtacaccgacaccagggttcgcctgggtgacgacatggatgacgctgtcacctacgcaatcgcccaggtgtatcctcgccagtccgaagattcccaggccgacatcttcgctgctatccgcagcgcgttcgatgagtacccgaacggcaccagccgaaagatcgcagtcatcggccacctgcgtcggtggcagatcgggcggatctatgggtaagcagaccaaggcgcgcagtgtcaaggaagctggtgtgaatattctcatcggctacaccatcaactactccgcgaacgtcaccctgctgccgatcctgtgggacaaggatcacccgttcctgagtgcgcacgccattggcgttgcgttcacgctgatcagcttcgtgcgtcagtacatcatccgccgctggttcaacaagggagactaacatggcgaagaccaagtacatcacgcacactgcgtgcgagttggagaaggttccgaaggctgccaagatcaacgaggtcatctcctcatacctcgtgcagatgaagtacgacggcatctgcggtgtggtgatctacgatccggatggcctcggtgtactcgcacagaccagaaccggcgagcgcatcctgaacttcaatcacgtactcgatgcgctggacacgctgccgttcgacatcctggccgagcaggtgcgggactccatcgacgtggaaggcgagccgctgcctgtgcagtgcaagcgcggcgtctacatcggcgagttctggcacccggacttcgctgcctccaccgtgtctggcttcaacaacctgaccgacaaggccaagatcgctgcagtgcaggcggacatcagcaaggttcagttcgtcgtgtgcgacttcgtgaccatcagtgagtggttcgatatgcacaccgacgtgggtttcgcggaccgcatcggccgcatcgcgtggatgcagggcatctatcaccccgacgacaacggcgtgttcggcaagaacatccggccgcccgcgccgccgatctggttcgcaggccatgagggctacctcagcgagcaggcggcagaggatgtgtacgcactggccgacgaagccgtggccgcaggccgctacgatggcatcatccttcgcgccgagagcggtccttggacccagggtgcgcgagaccacaacgtcgtcaaggtgaagcccttcattacccgcgacctaatcgtcgtggatgtcgaggagggcaagggcaagtacaagggcatgcttggcaacctgatcgtggaatacaaaggcaaccgcatgggcctgtccggcatgtccgatgccgagcgtcgtgagtggtgggcaaatcctggcaccatcatcggccagattgtggaagtcaaggcgatgagcgagagcgtcaagggcgtgctgcgcgagccgcgcttcaagggcatccgctacgacaccgaggtggacgcatgatcgacgtcaccgtggtgaacaggcccgaggctcagatggtgcgcatcttgatcgacgtgcccttcgagcagtacgcaagcgcgctgtacccgaaccaagttctgcgagacggcgttaacgatgcaatggacatcgtgcttgcggaggcacaacacaaccggagataacatgcagacacagcaggaactggaagaagagatgtacgcctacggccgcacccgcatggccgacagcatcgccaccaacgaagagaaggggcgggctgaagctaacccctatgctcagaagttgtaccgcaccttcctgttcccactgcgtgacctgctggtttcggagttggccgagcgcaagcccggccgccgtcaggcgcacgctgctctgctcgctggtatggacatggatgcggtggcatacctcgcggtgcgcaacgcactcagcaatgcgatgcaggacatcagtgtacgtgcagttgcgatccacgtaggcaaggctgtgtaccacgagtacctgctgtgtcagttcgaggacgctaagccagagttgttccactatctactcaacgacatcgaccgccgcatgtcttcggacgagcggtacaagatgaatgtaatgcgcaaccaagccaccaaggcgggagtcgagttcaaggagtggggcaacgcgcatgtgcagcaggtcgggtactacctgatcgacaagctggtgcaggttggcatgttcgaggtgacgaacaaccgcgagggaatcaccaacgtggttgagttgaacctcacccctgctgccgaggccatcgtatcgcagatcaccgagttcgttaccgagatggcaccgtactggacaccctgcgtagagccgccgaaggactggacatcgttgactgagggcggctaccacaccgagggcatgcgtcgcctcgatccgtacctagtgcacacgcacggtacagcccgcaggttcttcgagatggcggacatgagccgagagttccagtgcatcaacgcgcttcagcgtacgaagtggagagtgaaccgggacttgctggacatagcaacgaacgtgtcgtaccacttcgacatggaagagattatgatgcaggcggacttgccgaagcccgcgcgccctgcttggcttcttgatcagaagcccgaggacatgaacgaggacgaactgaagtccttccgtgcatggaagcgcgagatggctggttggcacaccgatgcaaagctgcgcaagctcaagggctaccgatttgcgaacgtgatgaaggaggcgcgcaagttctctgactatcctgccatctacttcgtgtacttcatggacttccgaggccgcaagtatgtcaagaccaatggcatatcgccgcagggttccgacttgcagaaggctatgcttgagttcggcgagggtaagccgctgctgacccagggtgcgaaggattggttcatgatcaccggggcaaaccgattcggtgttgacaaggtgagctacgaggaccgcatcaagtgggtgcgcgacaacgagcatctgatcttggactgggcgcgcagcccggttgaatcctccgagtggatggaagccgacaagcccttccagttcctggcgtggtgcttggagtacgcgaagtggaaggtgcacggggacaagttcctgtcgcgcatctcggtcggtatggacggaagctgtaacggattgcaaaatttttccgcgatgctccgagacccagtgggcggcaaggcagtgaacctgctcccgtccctgctgcccaacgacatctaccagatggtggccgaccgggcgacggagttgcttgagcttgccgaggaagaccctgatgggttccgatccatgtggctgcggcacatcctgacgcgctcgctcgtcaagcgcagtgtcatgactttgccgtacggatcgaagcgcacatcgtgcaaggacttcatcatcaaggactacctgaaggctgggaagttcaaggagcttgacccgaaccagtacgagcgcgccgctgcctacctcagcttcaaggtgtgggaagcaatcggcgacgtggtggttaaggcgcgcgaagcgatggactggctgcaacagtccgcccgcaccatcatccgagcgggagacgagaacgttcgttggatcaccccaacggggttccccgttgtgcaggtgtacttcggcacggtcgagcaccgcatcaacaccaagcttgcaggcaacatgaagatccgagtgctgaccgagagcgacgagacgaacctggggcggcacaagaacggcatcgcgccgaacttcgtgcactccctggacgcatcccacctgacgggcaccacgctgcgctgcgcggacgagggcatgaccgccttccacatggtgcacgacgactacggaacgcacgctgcggacgcgcctgcgatgttcagggccatccgcgaggtcttcgtggacatgtaccagcagcacgacatgcttcaggaactccgcgacgcctacggcatcctctccgagccgccctcgcagggcagcctggacctcacgcaagtccttgattcgccttactttttcgggtgaggcgagtttcagtacacgtacaacagatgaacctactccccggcttgggcttcggcctgagtcggggagcgttgtgctgtctgagttttggtacacgtacaatacaggagaacgcatgtcactcatttcagtacccgcaccggcagacagcctgtccccggaggcgatcaagaagatcgaggcgaagctcggcggtatggcgaatcctcaaatcaacagtggcacctcgcacctggaggctggtcagaaactcggcgttcagttggtgctgcgcatcctccgcgatgggtggaatcagtaacttagcgcaactctgcatctgtctttaggtaccattagtaagcttacataggagacggatagatgggatttggactgagtagcatctggggtggaggtgacgctaagcgtgcagccaagatgcaagctgatgctatcaaagagcagacggctgctactgtgcgacaagctggattggctgctgagcaagctgctagtcagattcgcaatacgatgcttaccgagactgctacgcaatatgcgcagacactactcggtcggcccatggaacaggtcaacgtgcgtctagctccgcaggagcaagcagctacgactgaccgtacccaacgtcagcgttccgttcgtgacacttacctgtccggtggatcgtggttcgcgtaaggagtaaccgatgaatcactttgtcaatacggcaggtgcccgatgggctaagctggacggtgttcgcggtaacatcatccgacgagccgaacgctttgccaagtggactatcgccaaggtgttcccttgtgatagctacaaccagaacaatgaaacgctcagcaatgagtggcaatctctcggtgcgcaggcagtgaatcatctcagcaataagctggttatgaacctgttcgctccatcccgtcccttcttccgccttggtcccaagaaagccgcacaagaacaactggctaccattgcagcggaacaacggaaggcgatggagaacaagctgtcggttgtggagcgtgaagcttccgacgtgatcgacaagctctcactacgcgctaagctgtacgaactgctgaagctcctgatcatcaccggcaatgcgctgatggtgctgaaggataacaagagcatgcgcgtattgacgatgcgcaactatgtggttcgccgagatgtcaacggtgaagtaatcgagatgctgattcgcgagaaggtgcacaaggcggagatggatcaggacgctctgtccatggcgctgcgctctggtcagttctctctggaccccgatggctgcgcacaccacttccggtggatcacattggatgcgggcaagtaccgggaggatcagtggtacaacgacttcaagttgccgatgcagtattcttccacgtatgcgaaggacaaggttccctaccatgctgtgacgtgggacttgacgagcgggaaccactacggtaccggcttggtcgaggactacaagaatgacttcgcatcgctgaccgcgttgtcccagtccaccgtgatggctgcgatcatgaactcggagttccggtggctcatccgcgcaggtgcgatgacctcggcacaggacatggcgaacagccgcaacggcgacgtgttgtacggtgagcagggagacatcactcctctagcctcgggtctggaatcgaagatcgaatccaatatcgccattgcccagcagtacatccagcgcatcggctccgcgttcctcttgcagtctgcggtcacccgccaggctgagcgcgtcactgcgcaggaacttcggatgaacgccgaggagttggaaggtggactcggcggagcgtactcgcgactggcagcaggcttgcaggttccgctcgcggacttctgccttgcctacgccgggtactccgttgccaacacgaacttcgaggcgaccgtgatcaccggtctggccgcgctgtcccgtgtgggtgatcgagaccggctgctggaatacttgcagtccctcgcgatggctgcgaacctcccgcctctcatgcttcagcgcatgaagatcagcaccctgatgtctgacctcgcgtctgcggtcggcttggaccgtgacaactacgtctactccgatgccgagttccagcagatgcagcagcagcaggcacaagaacagcaacagcagatggccgtgcaggccgctgtccaacaggagacccgtgcatgaccgagaatgtgaacccgaatccggccgctaccgagcagcctaccaccgttccgaatccgcaggctgcggttgtcgagaaccccacgcccacgccgcaaacccctgcccccccggccaagaccgaacaggctactccgtacgcggcggacaccggctccaagcagttggatgtcgcgctggggttcttcgtcaaccacctgggtctcagcccggattcgccggaagttgtggaggcacagcgcaccggcaacttcgagtacctgaagggccacgcagcacagaagggcatcgccccggaactgctgagtccgtacatcgcactggccgaaggtggccgcgaggaactgaccaaaggcgtcgaggcgcgacaggccgagcttgccaaggaactcgacggctatgccggtggcaccgagcagcgcgtggctaccctcgcgttcgtgaaggcgaactccaccgacgagcagttggccgagttcgatgaaattctcaaccgtggtggcatcggcgcgcaggcgctgatgatgctgttccagagcaagatgcgtgcggacccgaacgtcagcacccagggcaaggaagcggttgttccgaacgcaggcgcgcaggttccggcgcaggcgacacagtacccgagccgcgaggcgtggcgtgctgcccagcgtgacctgatcaatcggttcggtttgaccggttatcaggctaccccggaaggcaaggcccacgcggctgcgttccccggttaattgttccaccaacaacaactagaaaggagcttcatacatgagcaatatctggggtccgaccaatcccgtcaaccagaaccagcagttgggtgcaggcccgctggacgcgcttcagcaggagcagttcaccggtgaggtcgagcatgcctacatggcaaccacggtgttcgagccgcacttcaagcgcaagatggtcgtcaagggtaccaacaccctgaccaagaaggccatcggccgcacctcgcttcagaagctgggtcgtggtcaggcgccggacggcaagcaggtgaagttctccaaggcgcaggtgaccgtggacaccatgctgctgtcgcgccacaccttcgatgaactggagaccatccagaccgacatcgacgcgcgagccgaagtctccacgcaggcgggccgcgacatcgcggacttctacgaccagaccatcgccatcgccggtgtgaaggctgcgcgcgccaccgccaacccgtacggcctgaccgctgcggatggcttctacggcggcacccaggtcaccatcgcgagcggcgacgaactggatccggccaagctgtaccacgcgctgggtcagttgctgatgcagatggaagagaagaacgtggacccgcgccgcgagaagctgctcctggccgtgcgcccggcgcagtattacgtcctgatggatgccgagcagatcgtcaacggtgagtacatcacctcgaacggcaacaagctcgacaacatcccgatgttcaaggcgtggggcatcccgatcatctcgaccaacaacctgccgaagggcgtggtcaccggccacctgctgtccaacgaggacaacggcaacttctacgacggcgacttcaccaacgtcatcgccctggctatcggcccgaaggcgctgatgatcggcgagtccaagccgttgcagaccaagatctggtactcggatgagtcgaaggtctggaccgtcgatgcgtggttctcgttcggcatcgcgccggatcgcaccgagcatgccggtgtggtgcaggtcggctaatcaacacgggcgcagtccctgaatccttcgggtaactcaaactgcgcccactcaactaggaggccacatggcaaccatcgctgcaaagctcccgttcgctccgggcaccaccgtccagttgtccgctgcggtggacgtgtatccggacaaggccccggcgtacgtctgcttctaccagatcgtcggcaccaccctgtacgtgcaggttcgtgtgcaggacgacagccccgaagtgggtaccttcgacctgttcattccggtcacgggtatcgaggcgctgggtaccccgtaacaagccgccccgctctctaactgagggcggggcattattggatcaaggagagtctaatgtttatcagtaagctcgacgtcgttaatgacgcactgtcgtgcctcggcgaagcgggcctgactgaccttcaggaagaccacgcctaccgggatctgatcctcagcttcctcaaggctgagacggatcgcatctgtgcgcgcggttggtggttcaatcaggagtacacccgcctgctgcccgatgcaaactcccggtacatctacgttcccgaggacgtgtactctgtggtcaccggctgcaatggcttcagcgtcacgcagatgggccgccgcatgtacgacgcgcgccgtcgcacctacgagtgggaccggccgctgcctgttcgactcacgcgcatgttcccgttcgaggacttgccgtacatcgcgacggaggccatccgcgacgccaccacggtgaagttccaaggccgagtcgatgccgaccgcgagaccaagcaagacgccatgcgaactgcggcgaactcgatggagcagttggtccggatcgacgcgcagaaccagaagcacaacatgctgtaccgtaacggcatggagcgcaacgcctggattgcaacgaaccagcagtaccccgcaggggagcgagacatcctcggacccaacatcatcgttcactaggaggcagcatgagcaagaccgtaggcagcttgccctcattggtgcagggcgtatcggagcaagagccgcacaaccgtgcgccgggtcagatgtgggaaagcgtcaacatgatcgactccccgaccaagggcaaggcacgtcgtcgcggcaccgtgtactcgcaccatgtcgagttgccctcggccattgctgaggctctggtggaggcgcgctcccacacggagtacaccttcatcatcgacggcaaggagtacagcctgatctaccgtagccgcgcatcgacgctcggcaaggattacttcgcacaactgctggacaaggacaccgggcagttctacgacatcgtatacgagaacagcacatgggtggacaatctgattgccgggggcgtgtcggccgtggcgtgtatcggacggtacgtatacctcgcggggaataccaccctgccgcgcgcgacttctaccgaagcatggaactctcctgccaacttgcagaagctcagcgcttgggtgcgcgagggtgcgtacagccggaagttcactgtggttctttatcatgtgaacgggaccaagcaggagtttgcttacaccacgctcgctgctgcctacccggaactgctggacacgtcggacatcccgttctacaagccgaatacgaacccgcaggaggttgaccctgagtaccagaagcgagtgaatgatcgcgtcaatgcgtacgagggtgagaagtccgcgtggattcgcaaggctgcggaggacattgtcccggctaacatcgcgcgcaagctcgccgagttgatcagcacggcaggcattgcggcgtcctcgctcggcccttgcgttgtggtagacgatccgaactacaatgacatccgcctgcttgacgacggcagcaatacgctcgtctcctatgcgggcaaggaagtcagtgatccgcagttcgtcaccctgtaccattgggcaggcaaggtcgtccgcgtgcggccgtccggcggcggggacaaggagagctactacctgaaggccgtggccttggactccactgctactggctggacgaaggtcgagtgggtggaggcagccggtgtggtacacgagattcacaacgtggtctctcagttggtcatcgaccctgcgctgaagactgcgtacgtggcccaggatggtgcaggtctgaagtcccttgctcctcagcttggtgaccacccactgtacaagggcaacgtcgtcggcgatgccatcactgcgccgctgccgcactacttcgggcgggtgatcagttgcatgaccgtgttccaagatcggctgatgatctgcgctgacaacatcgtgaacttctcgcggtcctcggactacctgaacttcttccgcgtcaccgtgctgaacatccaagacaacgatcctatcgaaatcttcgcccacgggtccgaaggcgacacgatcaagcgcgctgtgatgttcgagcgggacatggttctgttcggagaactccggcagtacgcgatcaacgggcgtgagttcctgtctccgacgaacccgaacatcaatgtgatcgggaacttcgagggcggtgtgcgcgcccagcccattgcgtccggcaacttcctgttcttcgggaagcacgccaacgaacgcacgggcctgcaccagatgcagccgggcgagaccgcacagaccaccgttgtgtacgacgtgtcgcaggtgctggacacgtacatcgcgggcgagccggtgcagttgctgggcacgaccatgccgaacatgatcacgtaccggacggatgcggacccctcgatttggtacacgtacaggtacgcagacgagcaggggactgggcgcgtaatgtccagttggggcaagcagcagtacgctccggagttgggtacggttgctgctatcacgcactaccgtggcgacttgtacgtaatcaccttgcgctctgctggtgggaaggactactggtttgcagacaagctcagcctgaacgttgacctcgcgcgctacccacatctggattcccaggttcggtacgggcaggagactccgtggcatgttgctgcgcgctcttcgttgtacgtggcagcggacaagtcctcggactacttcctgctgggcgcaaagcgagaggctgcggaggacttcatcgagcaggctcctggcgtggagtccgcgctggttgtaggttccgtaagccccgcgtacttccagcccacgaacccgtacatgcgggacagccaggggcagccgatcctcaacgggcgcatcacgctcgcgtcgtacggcttccacctcgccgacaccggaggcatgcgggcatacgtactcaagcctgaccgagagcgtaccctgctgttcgagggtcgcgtcatcggaaacaccagcaacatcatcgggcggcagccggtctactccggaatccgcaccgtaagcgtagggcgcgagacgcgcacctgcatcattgaactgcggtcggaggactggcagccgctccgcgtcaccggcgctgagtggtctggtcaggtcttcatgccgcgcgcacgaggactctactaatggatggattgggtaccatcctgcaagcaaacaacatcacccgcgtggctcgtgcgaagtaccaatccgccgttgccacgcaggccgcgaacaacaagctcaagaaagcgcagggggacttggccaactggtcccggtccctcagcaaccgccgacgtgtggaggcagcgcagaaggagttcaatcgcggcgtagagcagttgagcaacgagacccggcaggctggtaagcaggcaacgggtatcaccctggacagttctgagcagcgcggtgcactactggcccgcgctgcgatgactggcgtgggcggctccactgtcgaggcgatggagaatctgatcaacttgcaggctgcaacttcgcaggaagagattgatcaggcagtggacaacatgcagtacagtgcgaagcagaacctgaccactgcgctcatgaacacgtacatgtcgcaggacttctcgcagaccatgatggacttcgacttcaccaagcacatcgagccacagggcatgaagcgccgcctcggcaagctggtaggcgttgcggttgcgacgtactttggcgggccgatggcaggcgaggccgtgtccaatctcgcagtcggcgagtggcaggcaacgaacggcgacttccaaggcgcgaatcagtccttcggtgctgcgatgacacaggccggtggggcgatgcagcagtggagtgaccgtggcggcactgcctggggcgaggatgtgtggcgcggtatgcgtgccaacggaagcaacgcgggtgctgcatccatccaggcaacaggcgggatgtccaccaagaaggcgcagtctgcgtcgagcagcagtaagtcttggttcaaataacaggaggcaatatggcaggtattcagttcaagcccgtcggtggtctgcaaggcggggccagtggtggcggcgctgctgtgcctaccgtaggcattagcggaggaggtggtgcgagcagcaacacgccgatgcgaagtggtgccgaatggttcgaccggggcatgcgggcggacttcggtggtgaccttccggggttcctcaacgaggtcttcgctgctccgctcgcagtggctaagcaggagcgtgagtggaaggggtacaccgatgccgctgccggtgtgaccgcagaagagatccgtgcacagcagccgtggtacacgaaaatcttcgggccgactcagtacgagtccggcgcaatcgcgttcgagaatcagaagaaggcttcggatctgatccgcgactggacgctgcgcatgccggagttgcggcagatgcccgccgagcaagtgagcgcacagttgcgggagcagatgaacagcatgatggggaacaacccgttcgccaacgctgtgcttcagaagtccctgctcactcagtacgcgccgctgcttgagcagcacggcaaggagcgcatcgcgtggcagcagagtcaactgctgaagtcccaggtcgagaacttccaatcgaactcggccacgtaccaactgctgatgtcgaaggccgcaaccctcggcaccgatcagcccatggacatcaacacggccaagcagttggaggccgcgaagagttctctgttcgatgctttgaccacaggccagttccagacggacgacagcgtgaagtccttcatcatgacgggcatccgctcggcaatgcgtagcggtgagttctacaccgtcgaggcaatgatggacgagaacatcctcggtgcgctgccaatcgagactgccgagcagattcagaaggcgtacatcaccgcgaaggcgcagtacaagaatcgcttcactgctgacaacccggacttcgagaagatgatggctaaggccgcagcctcgcggcacctgggtattggcggcgagccgatgctcgcgcagttgcgggaaatcaatagcacgtactccgctctgacgggtgacccggatgggttctacgactccgcacagatgtcggcctatgcgggcgacgccacctcgtcgtggctgcgtcggttcgagcggcaggaagacaagatggatcgtctgaaagagaaggccgccgacaatgccgcaaaggcggaggtcgaggcgcgcaacacggcgcagttgcaggagttcttcgtcagcggttcgctgggcgaggccataaacatgaagggagtcgagcgcggcgatgccgaccgtgcatccactgcgcggttctcgatgctgatgggtgagcagaaggtcgatcaggcgatgggcaacctcgtgtacaacttcaacaacacgaagggcagctacaagaacgagcagttggctcagcagatgcagacgaacttgcagaacagcatggacgagcaggtgagcgacgccttcatggtgcagcacaagatgtggaaggcgctctacacctcgcctgggtacgccatgcaggacggtgacgtggttcttacggatgctgcgcaaggtcaggccgctgctatcgggtactacggcgagacgctgaaccgcaagatggtggagttcgatcagaagctgacggcgggcatgacctccgaccgtgcgtacgctaccacgttcggtccctgggttgctgctggtcggcccgacttccgtggcatcgagcgtgacgatcagaagcaggcgacgaaggctttcctaggagcgatccgtggtgagtccgctggtatgttctcgcgcatgttcggcaacgggttcaagctgcacccgtccgcagaggcgcagttggcccaggcggttggcccgtactacgagcagttggatgcagggcttctcccggagcagcgcgcgaaggcggcgatgaacctcgccaagcagggtgggcgcatcgagattgtcggtgggcagttcctgcactggaaccgaaaccagcagccgctgacgaagtacatgggtgatcctgatggtgagcgtacctcgctgctgttcgacactgtgctgcgtgagcgcctgaagtccgtaggcaccacccccgatggcaactccatcgtgatcaaccgcctgcctgatgagaagggagacccggtgtacgcagtgcatgtggagacctccgatggtttctacaacgttgacatccgaggctccgacctcacgagctacgacgagaagaagctgcgcgcacgtcgcgagcagatggaggcgccgcgtcagatgctgccaatccccaagcccaactcgaatatccgattcaactaaggaggattcatgaacactcttgatcttgcaggtcttacgctggaccagaagtttgaagcagcgggcaagttcgcgggtgttccctcgcaactgttcgcaggaatgtgggcagtggaatccgggaagggcaccaacatgacctcgcgcgctggtgcgcggggtcacttccagaccatgcccgatactcaggctacctgggaagagcgcacggggcgcagcttcgaccccgacaacttcgatgactccctgaacatggccgcgctgacgatgcgcgagaacatgcagaagttcaagaccatcccggatgcgctgcgtgcgtacaactctgggtgggaccgctccaagtggggcaacgacgagacctcctcctacgtgggcaagatcgcaaccgagggcggcatggccctggccggtgcgatgaccatgacctacaataaggtcaacccgaacggtaacatggacgccgcattcaagggcaaggacttcgatgaggctttgttcgagaaggcgtgggcaggcgaggcgctgggggacttctccgcgcttaaggctgctgccatcaagaagcacctgaccgatgtcgagaagggcaccgccaatctcgctgccgtgcagaccgctgcgatcaacgtaggcaacgccaacgtggcggagcttgctcacgcagcgcaggccaaggtcgagaacgatgcggctgccaacgtggctgcgtacaccgcgactactggcaagtccaccatcgacaccagcacggcctcgatcagttcgggcgaggtgaagaagcgcatggatgccgcgctagagcgtgaggcgtatgcgcagtccctgaccgccaccgacaagtggggtgctagcttcggcagcagcctgatggcgggtatgatgcggtactacgacaacgaagtcaacgatgcgtacccgaagggctggtcttatatggactccgcgtatgagcaggagaagggctactccctgcgcgagcgcgagttcctgcgcgaggctgtaagcccgcaggatctggcacgaatccaaggcgacatcgctcagcagcgtgcagatgcacagcttctcggccacctgtcgcagtcctctcgcttcggctggtctattgctgctgggttctcggacccggtgggctgggctgcgggcctgggcgtcggcaaagcggcgcagatggcgaaggttggcgctgcaacgtacatcgcggcaggccgccccatctctgcactggctgctgctggtgctgagggtgccatcggcaacctgatcacgggtgccgctctggatgcgatgggagactaccgcaccttgggcgactacgtgagtgatgcgggctttgggttggcgttcggcgctgtgttgtcggcgcccggcattgcacgcgacgcgcggattgctggtgtccagcgtgcgatgcacgcacaggccgccatcaacgatgcagagcttgccctacgtgcgcaggagatggccgggccgggtgcaacgccggatcagttggcgcgtgcgatgcagactgtcgaggaagcagacgacaatgcgtggcggcaggccaccttgggcaacgttccggacggtgaccgcttcatggcccgtgcaaacgtgggcgaggccgccgatcctgccgtgagctacagccgattcgccaacgacggtgaccgtctggcctatatccagcagaagcagttcgatcagtccatcgcaggcgacgacatgcgtgccatggtggcggagtttagcgtgcgaagcgaggacatcgtgcgtcggtaccctatcgatgaggcgaagctgaagaccttcctgtctgccgtggactttgaggccacatccaccacgctgatggcggataagtctccggtgtccaaggcactcggcatcctcatcgcggagtctccggaaggtgcggcaggccgccacagcactgcatccgtctcgcgtaccgctcacttcgagcagtacatgggcaacatcaaccgcaacacggacaccctgttcgatatgtgggcgcgggagcagggcttcggcactgtgcgtcaggcgatggacccagaggtgcgcatccgattcaacaaggaagtgcagttggagatgaatcggcgctggaacaagcagccagagggtgcgatccaccccgcagtgaagcgcgcggcggacatctacgaccagggctacaagatcatgggtaaggatcagcgccacgtaggtgttatcggagcggatgcgatcgatcttgagaacaatggctacttccagcggtcttggaacctggggatgctgcgaggtatgggtgcatcccagcgctcggcgttcgtcaacgcgctggaagatcagttccgcacagttgcgggcttcaccgacagcgctgacttcaatgttcgtgccctggccgtgacttacctggctcgattggagcatcgtgcagtcggtatgctggacgtgcctgccaatctgtactccaatgatgcgggtgctatcgtccgcgacgccctgcactccctgggcctgagccaggatgaggttgagcggcagatgcagcgtttcacgcgcggtggtgctggtcataccaagtcccgaatcgacatggactatggcaaaaagtacgacgacggtgcaggcaacaccttcacgctggtggacttcctcgacaacgacatgaatggactctaccgccgctatgcccagcgcactgccggtgacgttgccctggccaagtacggcatcatgggagagaacggcatcaaggtggcacgcgaggcaatgctgcggactggcgcaagccagaaagcgctcgatgccttcgatcagttgatggcagagatgactggcaagaaggtgggcacaggcgatccactgatcgcacagaacgcgcggtccctgaccaacctgtcccgcatgggcggcgctgtgtttcctcagatgggtgcttacctcgacgccgttgtcggcctcggtgcggtgcgtgcactgcgttctgctggtgcgatcaaccagatgcgcaaggaagtgcaggccatggtgcgaggtgagaaggtgcacaacccgatcctgtctgggctggaaggtatcggccccgagttcggcactgcggactaccgcatcttcggcatcttcgacactccggagatggcagacatcgctggacgtgagtccgttggtgtggtgacgaaggcgatccgcgccggttccaacttgcagcgcgttctgtccggacaccgctgggttaccgctgcgcaggagcgcggcttcgcggaccagatcgtgcgcaaggctgcgcgcttcctgcgtgaaaccgatccgggtgttgacaatgtggccctgaaggacatgggcatcactggcgagatggcaaccacgatgcgtgatcggctgaagaagatcgccaccttcgataagagtggcgagttgatgtcctttgacccgcgcaagctggacgttgacgacatcgcaggccgccgtgcagtgatcgcattccgcgatgccgtgatgcgcggcacccggcagatcatgaacaaggagttccccggcgaagtcggcaagtgggcgcacaacggttggctgaagctgctgttccagttccgcacgttctcgatggttgcgcagcagaagtcctttaaccgcatcctgcacacgcgcggtgcggcgaagctgactggcctgctgctcggcggcatggccgtcgctgctccgatccacatggctcgtgttgcactgcgtgcctccttgatgtcggagcaggaccgcgacgagttcatggagaagcagttgcacccgatggcccttggccgggcaaccatgaactacctcgctgcgatgggcctctgggccgacgtggttgaggcggggagcggcctcggcacggggtgggcagacgccttcgggttcgatatgccggagtccctgaagcccacgggtgggcgcacgatgaaggatacggacctgatcggcggccagttggccccgtccctcggcgtgatcaacgacatcgggcagggcgtcatgggcaagccggacaagctgtggaagtccgccccgttcgcctcgctgccgtacatccagcccgttctgatgggcattgacagcgccctggatgagggcgagtaacagaccaatgcgggccaaggacggcccgagttttggtacacgtacaacaaggagaagacatggcgacgatcaccgatccaaccttccgtttcgccaccaacgttttcgacacggatggcacggacaaggtgtacgacattagcttcgagcttggctacatcgacggtgaatacgtcgttgctatgtcaggagtcgaagaccccgatactaagctgctgaccgacatgcaggcgcacactgttgcgtttactgacacgcctccgggcactcgtgttaaggtcagccctgtgccggtctctgggcgcaagctcatcatcttccgtcagactgacatcagcaaactgctggtgaagttccaagacggaaagcttcagaccgggcgaaacctggatctgaactccacgcagttgatcatggcgatccaggaaatccttgacgggttgcgcaacaacaaccttatcgtggagcagcagatcggcacggtcgttgatatgaacaagctgatcaaccagatctaccagcaggttctacaactcctggcttctggtggtatcgtgtctgtcacgccgcgcgtgtggagtggagtgtggtccgaggcgtccgagactctgggcgacacggacttcgagattcccggcgcggacgtgtccggtgcagggttctacgacacctacatcgagggcgtgggcttgcagcctggggaggacttttccatcatcctcggcgacaacccgactattcggttctcgcgcggagactggcccgacggcactcggtggttcaccgtgcttcgcgggtatgccaagccgtacaccggcccggctcccgtcacgaccctcgcgtacccgatcatccgaagcggtgcctcggcgtacttcattgaccagacctctgcgttctctgtggtcttgctgtcctcgccgagcgcggtgaccgcaacggtgaagctcatccctccggccgcttccaacaaggtggccaccggcacgttcatcacgctggttcagcgcggcggggtcgtgtccctgtctgccgatcctggcgtcaacctgatcatccctgccggtaccatcgcgcgcactcgcgcagccaacagcgcactgtctctgacgtgcctcgatgctgacgcgaacgagtggttggtctccggggatcttgcaaagcaggagtaaccaatgcactttcgtctgttcgaccggccgctgatcgtagacgatcctctggctagtatgtacatcgacggacagtacgaagactacaacccaggccaagcctacgagggccgtgtgcaaattcacggtgcggtgggctttgccaaagtcgaagtgctgagcgccaacctgcctcccggctactacgtctacgtggacaacgtgacgaaggaggtggttgttcgctggagtccctatactccgccgaccgagacttttaccttggtcgagaatggggacttctccgcaggggacaatggggcctggacgaataccggcgccgatgcgccgttcgtgatcgagcctgatagtggcggcaacatgtcgatgaagttcaaggaagggttcggcggtgggtactactctgagagtgtactagctccgatcaaggacatcaatcgacagatcaccgccaccgggcgtatcgcacaaggcaagtcgtccaagcgcaagctgtggggcggcatcgtactcgcgttccatgatgctaaccgcaacctcctgaactaccttgaaagcaactgggtcaactccgggggcgattacaaggacgttaaggttgttgcggcggccgcagactcgaaggcgaagttcgtcagcgtccgcatccagttcgatcgcaagggccagaactacccggcctgggccgacgacatcaagtgggaccactcgtggacgaagggatacaacgacgacgagcagttgtcggttaccgtgcgagtcacggactcccttaacaacactgccacgcacaccggcactatcgatgagcggagcaactggtactacggcaagctcaatggcttgtacatgtacgacagcctcggactcaccggtaccgcgcttggtattaacttcggtgggcagcagcatggctccgactacgccgcactcagcggttccgtcacgagcttcctgtccaacactgtcgtcaaggcggacctgaagtccatggagtccatctccatctccggtgcaattgctagcatgcggcagcgcaacgtcgctatccgctacgtcagcaccccggaggcagcatccctcagcggccgggcgtcctcgttcaagagcaagacgcatgtggactacaagcgtgcgcgcgccgaaaccgtcaccatctccgcacgaattggaggcttcagaatcacatgatcaacaacaaggtaggcgtctccggacgcttcaaggtgcaggttctgcgctccgatggctctgtccgaatggatcgtgactggcagaagaacctgatcacgaactatggcatggaccacctcagcagcaagcaccagagtacggtcggccaggccaacatgatgcagtacatccgcgtgggcactggctcctcgactccggcgaacactgacgttgccctggcaaatcaagtgggctacaaggattccgccgggcagtccacgcggatcgctcctgtcgcaaccgatgcttcgccgtactgcggttggcgcgtccggtacgagttcgcggctggtgccgtggtcgggaacctcacggagcttggcgtcagccactccgccgaaggcaacaacctgtgcacccacgcgcagttcctggactccaacggtcagccgatcacggtggtcgttgctgccgacgagcagcttatcatcacctacgagttccgtctgtacttcccgaccacggcgtcctcggcgtctgtcacagacccaaacaccggtacggtgtacaccatccgtgcgctgcccgtcaacaccataaactggaattgggcggactacatcctgggcggtgtgctgggcggccagatcggcaactccgtcaacggtgcgcaggggtatgcctactacggaagcggcgcgggcctcagcagtgctgtgtctcctgtccccaacggtacaaacgtgtcgggcacgttcaactacaacaccgccctggcaacggacggttcgtactctaccaccactacggtgactgtgccgctgggttctctcaacgatctggacatcaaggtcgtccagaccactgagatgtccccgtcgtacttcgccccgctgtcgtggcagttcgagttcactccgacgtggcgcaagacctcggaccagaccgtgacgttcaccatccggttggagattgcccgcgtatgatccctcagttgaccgcagcgcaggctcgtgcgccgtgggcacagcagatgggaagtcgctccaagcccctgatcaactacgcggtcggtggtgacacccttggcgacagcgctaccatctcaggtaccacctgggttgtagagtacgtcggccaggaggtgcgcgtatacaagctggacgcacccgagacctacagcgtggccttctccggagcagacatcacgttcgtgagtctcgccttcgatcagtccatgcggtgggtcatcgggtacacgcaggccggagcaggcaagctgcactggttcgactcgattgtgggtgggtacaccacctacgtcgttccgggcgcagtgcagcccttcgtctccctcgacgtgcgcgataaggtgtacatcggagcgagcgacgtgatcatcagctacacccgcgacaccaatctctacacccgtgttcagcgggagcggtttgcgacggagcgacttctaaagtccgctgccggtgctgccctctcacgcttcgggctatccactgtcaaccgcctgcaatggcaggtacgaccctaggagtacaaatgaagctgcccgtcagcgttgaactagctgctgctaccccgttgacgggtttgtcgattgtcgtctcttggatgactgcgtactcgtcggccatcgtcaccggcctcgccatcctcgcgttcgttgcgcagatggtgtggcgatacctcgaacaccgcgcgatcatgcgcaagaactcggaggctcccaatggctaagaacgccgcaagcgaggacttcctcggcaccctgcacaacagcttcgctatctacctcacgtcgctcctgaccaaggaaggtggctgcaccgctgcggagcttgcagtcatcaattcgttcctcgacaagaacgacatcagttgcgctgtctcttcggacaacgcggtcggccggttgcgtgagcaactgaagggcgtaggtgcgcccgccgaggtcaccgacaaggacaaggagggagcgctcgcaggtgtgcttgacctcgcccagtaccgggcgggcggtaccggttgagcgccgacaagaactggcgagccgaacagcttgccgtccttcaggagcactacgggagcttctctctgttcctgaaggacatcatgtggtttctcggcgggtggactccaacgtggatgcagtacgacatcgctaactacttgcagcatgggccgcaagacctgatggttcaggcccagcgaggcgaggcgaagtccacgatcaccgcaatcttcgcggtgtggtgcatcatgatgaatcccaagttccgcgtgctgatcgtatcggcgggtggcaagcaggcaaacgagattgcgaatctcgtgacgaagatcatcctgttttgggagccgttggagtgcatccggccggacaagtccgctggtgaccgtacgtctgtcgaggcattcgacgtgcactactccctgaagggcgtggacaagtccccgtctgttgcgtgcatcggcatcaccggcaacctccctggcaagcgcgcggaccttctgattgcggacgacatcgagtccccgaagaactcgatgaccgcaggcaaccgcgagatgctgctcaccctgagcttggagttctcggctatcgcctctgggcagcccggcattccgccccgcatcgtgtacctggggactccgcagaccagcgagtccatctacaacacgctgccgggtcgcggcttcgacgttcgcatctggcctgggcggttcccaactcagaaggagatggcgaactacggtccgcacctcgcgccgcagatccgcaacgccatcgaggctgagccgagcctgcaatacggcggcggcatggctggtgacatgggcaagcccacggatccggtgatgttcaacgaggaaacgttgcagaagaagttccaggatcgtggtgcatcgtcgttccagttgaactacatgctcaatacgaagctcatggactcccttcgcttcccgctgaagaccgaggacatcatcgtcatcccaggtgcgcccacaggcaaggttccgcagatcatcatgcgcggcatcggtgcgcagaaccagaaggtctaccagtcctctggcctcgcgttcacctgcgcgcagcccatgatcgccaacgacgtgcagatgatcgacttcgagggcgtgcacatgcaggtggaccctgcgggcggcggtgcgaacggagatgaaacggggttcgctgtgactgcgtacgccaacagtaccatctacgtgcttgccatcggtggtattcctggcggctacggcgatgagcagatgaccatgcttgcaaagatcgcggagacgttcaaagcagggaccatcagcatcgaaaagaactacggttatggcgcattcgccaaggtctggctccctatcctgcacaagatatggaaggggacgatccttgagccgtatgtgggcggtatgaaggagaagcgcatcatcggaaccatcgagccagtcatcggccgaggatccctggtgttcttcgagtccgccatcaacatggatcacgacctgaccgagccgtacaacacctccggcaaccgcaagatgtactccgtcttccaccagcttaccaagatgcaggcaatcaagggatgcgtcaagcacgatgaccgtgcggacgccctcgaaggtagcgtgcggttctggatcgagcggctgaaggtggatcaaggtaagcgaaaggcccaggaagaggctcgcgaataccagaagtggctcgatgaccccgtgggttggagccgcaatcagcagcccgtgcgcacgtccatgaacgtcagcaccaaatacttcacataaggagaagcatatgtatcgcagtgacctcagcaattacactcgcgcctacggcggcggcaatcagttggtcacggagttcgtgaagctggtgggctacgtcgaggtgcacccgaactccgccgagcagatcctcgcgctgttcgatgcggacgtggcgaaggttcgcgcagcgatccaggcccagattcctgctccgcccgagggcgagtaatgaatagcttgccgctgatcgcaaacgcaaccaccatcggcgtcagtttgatgcaggcaaccacccaggaagaggcccgcgctgtcattggcgcgggtactggcggtggtggctcaggcggtgccgtggattccgtcaacggcaagaccggtgcggtggttctcactgcctccgatgtcgatgcgctgcccaccaccgccgccggttcgtccctcgcaaccctgagtggaggtaagatcccgaactcgcagttgcctgctctggctatcaccgagacgtacgtcgtcagttccgaggcgtcccaggtcgcactcgtagcacaagaaggtgacgtgtgcgtgcgcacggacctcgcgcggacgtacatccacctcaacactgccctgggcacgatggcagactggcaggagattctatctcccaccgcaccggtgcagtcagtgaacgggcagactggcaacgtgtccatctctgcttcgagcatcggagcggctaccacctcggacctcgcgaccaaggcaaccatgccaggaggctggactgcaatctcctccttcctcaacgggtgggttaacctgggaagcgcagacttcaacgatgtgcagtaccgcaaggtggacaaccgtatcgacctgcgtggcgtcgtcaagaaggacaactccactcgcaactcgatcttcaccatgcctgcgggcttccgtcctaacaggaacctgatcaacctgtgccttgcctacgctggaggcaacactatggcgcgcgtggacgtgaacatgaccggagatgtttcccttatcgatctggtcaacggagcctcggagtccaccggcattgtgttcctctctctggacgggatcaccttcgacattatctaaggagacactatgaagagccgcatcctcgccctgttggcgggtagcctgctgtccgtggcaggcgttgtgcacgtcatggacagtgagggcatccaccgcaaggcttatccggaccccggtactggcggagcgccatggacgatctgctacgggcacaccggcaagaaggttgtcaagggtctgatggtatcgcaggagcagtgcgaggcgtggctcgtccaagacctcaaggaacacgagggctatgtgcagaagctggtcaaggtgccgctccgacagggcacctacgacgccttggtcagcttctccttcaacgtagggccggacaacctcgcgaagtccacccttctgcgtaagctcaacgcaggccaatggcatgctgcctgtgatgagttcccgaaatggaagtatgccaacaagatcatcctcgaagggctggttgtacgccgcttcaaggagcaggccatgtgccgaaaggagggattgtatgtctaccgtccgtgattacatcatcattctgctgatcacgctgatcgtgggactgggtgcggctactttcatgctcaacaagcgcctcgacgcagcgcttgagcagaaggaaaacgccacctctctcgtcaagggctacgaggagtacacctctagcctcaacaagttcaccaaaaagcgggaggaagtccatgcggaagcagaacaagaccgtgttgtgcatcaagagtgggctgatcagcctgttcctgatgaccttgctgacaagctgcgcgagcattgagttcccgaaagcttggttggatgactgtgcggtgacctacccagcggatggtccgatgactcagtgggatttgtaccttctggctcaggatcgtaagctcgatgtggataggtgcaatgtcgataaggctgctcttcgtgcgttcgtagagtcccaccccaagctgagcatcaagaaatgacaactatcgcctgggatggtgagtacctgtactctgactcgcagtctactgcggataacacgaagtccaagtgcgttaagttgttcagagcgggcaaggcccggttggccttcacaggagaggtgcacaggttccctgccttagtcgcagcggttgcggccggtgaggatcccctgcctctcctgggttctgagacccgcatgttccatgtgctggacggtgtgctgaccatctacgatgacggggactcgtggacggagaccgcaccagcgttcgcagggagcgggtcccagttcgcccgtggtgcccatgcggcaggtgcctccgtggcgcaggcggtgcgcattgcggcggatctagacctatactccggtgggcctgtgcgtaggctccgggcttaaatttgatattgtcgtgcgcgggggtacctcagatcgcaggctcccgcgcgcccccgtatgggtaccccgcgcacgcacgcgcgttctatccctgatccacacatgggcctgcgcccgcctgagcgcgtgcacacgggctgcgcacacatgcgcctgcacgcacctacgcgcgcacaccgcacgcctgcgatacgcacgcacacgcgtttcaccctaggcaccattgctgaacgcgttcagaattttcccatcgattcacctccgatcttcacgccgccttaacatccgatgcggtagtctacacccatcgcagcaatgcaccgcagcgacaccgttacaacctcgtgcctaggcgtagcagcgtgcctatgatgggcgagggagaccaccggggtacctacacagggccggagggtcggcggggcaggaacgcacgctgagcgcgtgtgagcggcatctgtatcattttgctggacatgtaacacacgggtagcgcactggtgtactacctgagtaacacaccgatacacgatttggtacacgtacaacagatagaccgccgtattgcaaccatcctcttgacactggggggacaaggcccgcacactcactcctagaacggagtcattgtgggtagcgatacggacccttagatgggaacggactagctgggcttacagtgccatccgcttatctgcacttgatgttccaacgtagttggcgagtcgtagataggagttgacgacttaccacccggtaagtgttgacaggtagcttaggacgtgtcaccatagcttcgcagtagttagacaggtgggcttagacagacacttgacaggagtgagacagtaggctagtatgagtctcacatggttaagcaccgcagcgaatcgcagcgcttggcacatgaagaagaatgtattagcctattgacaacgacttgcgagtcag

SEQ ID NO: 23 - DNA, 43324 bp, Unknown
  Bacteriophage Xfas305
ggtcagcgccgcgcccaccgggaacacctgctccagcaggttgccggtcggctcaccgtcttccagctcggggacttggatgatcggcttgcggatggattccttgtcgatgttggcgtacgtcttcttcttgccttccgggccgcgctccacgtggaccacgttcagcagcaccggcttgcccagcagctggacgaagtgcttctcgtcggtgcgcaggcgggagaacatcttgaagtatgcggccttctccttggtcgagaggttgaggcgcaggctcaggcggaccggaatcttgacgccgccatccagttccttcggcggatgcttcttgccgatcagctcgaacacgatgatgacttcgttgttggtcttcttcttgccctcgaactcgctctcgtgttggcccacctcgtagtaggcgacgatgcgagcgccggtctgcccggcttcgggcggggtgtagtcgccgccaccggcggacgccacggactggtcctgacccttttcctgcacctgcttcagcagcttgtcgagactcatgctttggtttctccttattcaaacgacgggttgtgattaccgatgaagtccttgcggatttgcatgcggtactcggggaacaagacggcgaactcctcgggagggttgtgctcctccatcatgttgtcgcccatcttggtttcgcatggcacgccgagaggtagcggccacttgaaccaccactccatgtagacggaggcttcgagcatgcttgcatgcaggagcgctgccgcttccgtggcgatggatgctgcgctgtccacgtataccgcatcgtggacctgattcaccagcagggcttggccgagccagcgttccggttgggtgacgtacatgcggtagaaggcacgcagcgagacgtacatgctcgccttggcccactcgccgccagtcccctgcaccgggtagttcttgatttccgtgggcgagaacgactgcgccacgccgccacgtgaggcgggcttggttgcgatgaacttgggagacggggactcgctgaaggagtacatcttcccgtccggcgtggtgaagtgcgagcggcccagctgacaggtcaggcccggcacgtccgggtgctgcacgaaccggccagtcgtaacgcggttggccttgatgacctccatcatgtggtcgatgtactcgcccagctccgggtaacgctcggcctcggcgcgcaccagcttctccacttcctcctcggtcatgcccgtggtcgctgcgatcttcgcaacgcctgcgccgtacgcacgctggaaggagaagaccttcgcgttgcctcgcatcttcttccacttgctgtgctccgggtgggtctcgtccttcgctgccttcaggatgtaggcgtagtccttgccttcggccgcaccccatgcctgctctgcgcgcagaacgtgcatgtcgagaccggccttcaggtcttcgatcagctgtcggcactcggtgaggatcgcctgcacgtagatttccagcgacgtgaagtccgactggatgatcttgccaccagcgtggcggctgatgaacgcgcgcttgatctggctgcccttctccttgccggtctcctcgtcgtactcgcccttgctcacgttctgcaagttcgggtcgctcgacgacaagcggccggtcacggtgttggtcatgttgagcttgtggtggatgataccgtccggcccaaccagcgtgagcattcccttctgctccccggtcttctcgtccgtcgtgatgaagtacgtggacaagtccttgtggatgtcggcgcgcttggcgagcgccttcaggaacgggatgtcacgagcgcccagctcctcgatcacttccgctgcggtggagtacacgcccggatcggacttgctctcccagcgctcgctgccctcggtgtatccggggaacacgaacaccatgtcctcgttgcggaacttgggcttggtcaggtcatcgaccttgaccttcttggtcttgcgctcgcccttgttcttgccaccagcgaacaccgccacgtcggggaacttctcggcgatgccgtcgaaggcttgcagctcgttggcgttgtactcgccgatgctccgagtggtgccgtccaccaacacgtagtgcagctcgtccttctggacgtactgctgcttgccggtttcgggaaccagcacgggaaccttcgccacgtacttgatggggccgccgaagatcagcgcgctcttgtggaagcggctgttccagttgaaggtcaagccctcgggcagctcggggatgtaggactccagctctgcggtggcgtcggcaagctcctgctccagcttcttcgcatgctccagtgcccacggcttgtccacgaacatgccgttgtactcggcctcgatggtgaagcacagcgcgcccatgttgagcagcgccgagcgcaggccgttgcgtgcccggaaggcatcgagctgtccgaggaacatcttctcggtgttgccgatgtcgcccacgtcgtcggtgtcgttggtgccgacgaggtagtccatcagcagggtcttgtcgatgtcgcacgtgtccacccctgcattccacagggacttcaccgcgtcgtccttcaggttgccgccgtacctcggggccacctcgtccatcgcgcacatgtggaactcttgggtcatgccgtgcagcaggtactcggcaagctggcagtcccacaccatgccgccacggtcgatgaactcgatccatgccatgcgattctgcgggccttggcagatggcgtgcaggatgtcgaacttgatgttgaagccgacgaggtactgcgcaccgtagcacagctccttcagccaaccatccggcgcaccgccgacgtagttgttgtcctcgtcacgcccggtggtgaagtaccggccgctgttcttggcgtcgcccttgcgcttgtggccgatggcgacgatgcggttgaggttgtagaacggattcgccttgcgcttcagcgtggcgcggatcgtggtctccaagtcgaaggacacgtaactcatgcttcctccttcacggcgaagcggtgcgcatggcaccagaccttcttgccgcagtcgtcgatgacctgcacgtatgcgggccatgtgaagttgatgtcgtgcgcctcgggctggtagccctgcaccgtgtactccttgccggtggtgaacaggtagccacgcgagcctcgacacactacggtgtcgcctgctttcatggcgtcttgcctcccggcttggtgatccacacggtgacgcacgggatcaggttgatgcaccagcgcaggttgtgcttgctgtaatgcacgcccatccacatgctgcccttgttcaccagccatccccacttccatcgggcgacgggagcatcttctgcactcgccttgtagatggcctcggcctgatcgctgcggtgggtgtagacacgcacgccgttcggcaggtccacaaaccacaggcgcttctgttcgttccaacgaatcttcatgcttcctcctcgtagaagcgggcacgctctgcgtcgaacatcacctcggcacgaggatcacgcttaccgcctgcgcggtgcagcttgttcttcggcgtgccgatgtagcggaagcgatccattgcgggatcgttgagcttgccgcccatgatgatgaagtcgcacgcgccctgcttgcccgtcttgctgtccttgagtgcggactgcggcgggaactggacaccctcgccctcggcgctgatctgcgaagtcgccacgcccacggcgtcgtacttcacacaccagttgcgcgcggcttggtacatggcttcgagcatctgatcggtacgctgcccgccgttggtcatgccgccggtgaaggtgatgttgtcgatcatgtcgaagatgatgaagccggggttggtctgcttgatgatcgcctcgacctcgcctgaggtgaagccgtggatgtcgtagaactgcatgcggtggatgtcgccacccatcgcttcctcgatccgcttgcggatgctgccgtccttcgcccactccaccatttcggggatcgttgcgttgagcagggactgataccagcgctgcttgattcgcttgcccggcccctcgttgttgagccagattccggtgcgcttctggtcaggccacaccgtgtccagctgcgggagccagaacgtggactcgctggtcaggaaagtggtcttgcctgcatcggggcgcatggcgtagatgccgaagtcgccgccgcgcatcgggcgcaggttgcggctcaggctgggcagtcggaagtggattccgatgtcgccctcgtccatcgccatcagctcctcgggcgtctcctgcaccagaggcagccgggccttgcggtccatgcgttcggtgatgccctcggccagagcggacagctcgtcacgcagagagaactcagcgccgccattccactgcacgatcttgctgacggcggacgtggcaagctccagctccagcagcttttcgatcatgccctgctccgcctcgggcgggacagactcgcgcatcgcacgcagctgcaacttcagcagggacttcttgtcgtccggcagctgcttgaacttgaactccatcgcccaaccatcgaacacgtcgtgcggcagagccttggtctcggggaactccttgtagtacgcgcgcagtgcatccagcatcagcacggtcagctcgtccagcccttcgcgcggagcgttcgggaccagccggtcgaacttgcccttgtcgctgcacaatcgcagcagtgtcaagtctaatgacatagcttctcctcaatgtagtcggtcggataatacttcgggtcacgtggtgacgtgatgttccgatagtccaagccgaacgcacggaggcgcgcggcaatttgctttgcggcatcctgaccgggattgctcccgtccgatctgcccttgtcgtcgtcgagccacgtcgctacacgttggcctcgctcaatcagctgcatcaacaccttgttgtgcagcttggtgccgagcaacgaccacgcttctgttaccagtcccaccttgtatgcggagagcgggtcttcgcatagaacgatggtgtctcccttgcccacgccgaagcgtgcgacgagtccgtctttcgggacatcaggagtcagccacttcggttgcctcgtagaggaccgggctgtccagtacacagggcggtcgccttccatgatgggtagtaccacgcgcccgatgtccgggcaccagtacaggccgagttccccgatcatgcgaagcgagaggcccatcttgtagaaccacaccttgtcacgcagcggccactcggttgtgtcatagacacgtggctctggcaactcaacagttgcgcgcactctgcgctcgctggtttgctcggcatgggttcgtactagcttggcttctaagctctcgtgctcacgcttgaatcctgtgccaccgcacctgaaacagtatgcggtggacttgtcgtgcgagcgagtgatgagcaacgagtttccctcaccacacgcatggttgatccgagtgcgggtgccgaccttcagtcgttccgcatgcggcagccagtcgctgtcaggtagttcgttgctcatcttgtcctcgctaggtcagtggctccagatcgaacccggagttgcgaaggcgacctcgccgttgctggtgttgaccagctgacggttgcccttcttgtcgttgacgttggtgacgagcaagtaggtgtcgccgtccaccacggtgccatcaccggtggcgatgcagcggtagttgtagccgaccttcaggtcacgcccggcgacgaacgccgtgcggctgggtgcggtgctcggggcggaagcgttcattcggcaccgccttcgccgcccgctgcggccgccgccttggctgcgtcgatgtcggcctgcgccttctcgatgtcctcgctggtgaacagcagggcggtggcgtcgatcaggtggaactcggcgtcgaagccctcgccgtgctcgaccttcagctgcacgacacccttctcgttcttcttggtggccgacacggtgccggacaggacgcgcttgttcaaggcacgaccgtagacgtaggccacggcgtcgcctgccttcagcgcttcgatggcggcctcgttggcgatgctcgcttcgatggcggcgatcttctcgtcgatcttgctcaccttctccagcgccttggcccggtcttcgcgcagctcgttcagcttgacttcggcgtgcgagaactgggtctgctgggcggtgttggtatcgttcgacatgtggtgtatctcctttcattgacgggttgatgggtggtccgtaacgtggtcccttccggcacgcaatcagtgcgagatttactggaagatcagctcgctgttgtacccgccgccgccattgtagaagcgacgacgcagcacgctctcctcgccgagcaccagcaggcggtccacgatggcgcggatggcgcccatgtactggtccaccagctcgctctgcaagttcatgtcgaagcggatcacggtcaccgcctcgtcatccagtgcgccggtatccttgcggacgtacaggccacgggcattggtcatcgtcgcaccgccgatcagcttgacggcggcggcaatctccggctgcacgttgagcagtcggctgtcaggcacggtcacctcgacccagcttcccatgcgcaggctcatgctgcacctgccagtgcggcctgcacgttcggctgcaacgatgcaccggcacgcagctcggctgcccggcgcttgatcttggtgcggaggcggcggcgttccttgttgttcgcgcccatcgcatcggccgctgccttcatcgcgttgttgcccacgttgcgggtctggcccggcccgcacatgtagtcccggcccagcatcttgcgcagcagcgggttctcgatgggaatcagcggcaccgagacgtgcaggtagcgggaggtgtccggcgcaggaggcggcgtgttgtcgtcatcgtgctgcggcttgatggcgttgaccaccttgtccttgatgtacttggcggcgctcttgatcttgtcgaggaaacccatcagcgtttctccttgttgtggaagtggttgaactccagctcatgccacacgtagtacgtggtgccgagcgggtcggtcattgcctgctcgttgcgcagcgtgcagtagtcgttggcctcgtcgaggttgtcgtaggtgcggacccacaacccatcgggagttgcctcgccggtgcggaaccggcacagcctaccgtcatcgtcatggtactggccgacgacgatccacggaccacgcccgacgacccagtagagcaggatcaggaggcgcaggccgagcttacgcatcggcgtagaccgcttcgatgaagtagcccgacgggttgcccttgctgcgcttgtcgccgagggtgtccagcacttcgcgggcggcggcacgggtcgggaacagcaggttgctctcgtcgttgttctcctcgtcgccgtcgatgcggacggtcgcgccgtcctcgacggagttgtagcagctgatgtagtcgccgtcgtacttgatgcgccaacccagcacgggctgcacgctgcgcaccttgtcgccgaactcgccgacgccgtagtcgaagtgcggggactcgaaggattccagctcgccgatggcagcacgggcggcggcgcgcttgtcccagaccaccacggttttcgggtaggtgccgtcacgcagtgcatccgacaggctatcggtcgcgccaggcttgatggtggacaggatttcctgcacttcctcggtggtggccgggcgggcaccggtcaggttcgggttggcgacgacgccgacgatggtgttggtgcccttggcacgggtgatgccgaagtaggtcttgctcatggttgattctcctcattgacgggtgggatttcgtactcctcgacatcagcgatgcggtcgtttgtcttgaccagcgccgcccatgcctcggcctcttctcgatcctcgaacgtccatccattgggtgcgccgaggtgctgaccgctgtaccactgcgcgcctgtcttcaggctcgtcatgtggacgcggtaacgcaggctgaccttacgcataccagcgctctacgctgtgctcgtaggtcacgaactctttccactggcgtggctgcgcagccagttgcatcggcgaacgcttgccgttatgtcggcgcttgaagatgacggggatcatgcaatgtgccctccttgttgggcgtgattccaaagctgcgccctcgttggaaggcgcagcggtagatcacgtgcggttcgggtgccacttcacgcggtagcggtggcggtcagcgatgggaacgtgggtgttgatggcgaggcgtgcgccctcggcggacgggaacgtgtcgcgcagccagtggctttcgctgcggccccagccgagcgggcggttcaccttgcggaagtattccaccacgtagtagccacggtcacgctccgggccgcccggcgtggtgctcggcacgacacggtagctgttcggattggtcccgtagcgcttgatcctcgcacgcatctggcgatacgcctcgttgcgggaggtgtacgtcgagttggcgatctgcccattgccaacgcagctcacccagctattcccgtgttcgaggtactgcacgatccacttcttcggctgggcttccggcgtcagggccacacggcgtgcagtctggtcgtccatcagcacgtcgggcagcggtcggcgcggcaggttgtccggcatcgggatgtccgagaggcgcatgcgcccggtcacggtgcgcggcggcggaatgggtgcgcccttcatcagactggcgagcaccagcacctccagcaggccgaggtcggcgtccagcatggatttgccgccactcgggcgggccatcggctgggtcagcagctcgccacggcgcacaccggccacgcctgccgggatcagctcgtggaagatcggcttgccgttgaaagtctccacctcggtgcggaaccgtgcgcccatcttgtgcggcagatcacgcagcaccgcatacagcggcgagctgccgccgacgtggctgaagcggaacgtgcccagcagctcggcctgttccttggtcagcaccagcacgtactggctgccgtcattggtcttcatggtagtcatgcgttcacgctctccttggtcagttcgtcgatcaggaaggtcagcaggcggcgacggctccggccatactcgctgtcctcgtcgtacatgttgccgttgtacagggcgcactcgtccaccgcgtcgaagtaggcggcagcggctgcatcgggatcgtcccagtccaccgtgtccatttcgttgtcggaacggtactcgtcgatcatgtcgtcatcttcgcccgacgccgggaccgggtacgtgctgcacccgctccactccggccactcccggtagagctgcgtgcggaggtccacggcagcgcccacctcgtcttgggtgtagtcgtcacgatagcggatgtcttgcatctggtcggcgagcttctcgcacagggcttcgccaagcgagttctcgtcgtcgatgtccgcacgggcggcgatggccgcagcgaggaggagcgcaacaacgcgctccccgtagattcccgtgaggcggctcatgccttcacctcggcgctcttgcgcttggcggcgggcttcggcaccttgtgcgcggcttcgatcacggcgcgctcctcctcggacggagtatagccgccctcgacggccttctccagacggcccagcagcttgtgcaggtccgcagcgaagctgaactcctcggcgggcttctcggtcttgaagtcgtgccacatcttggcggcggcgcgctccagcatggcggccagctcctcgccctccagccgcttgctcttggcgtacttcatcggcatggcggccttggtctccttgtcgtcgttcggagccatcgggccgaactcggacaggtacaggcgcagcgcctcgtgcttcatgccgttgcccacggcaaggcacaggtcggacgccagagtcacgtcgccgtggacgtgggcatggttgatgacggcgatggcggtctgctggatcgtgtccaccagcttggtgcgcgccgtattgatggccttgatgctcttgcggatgttggccgcattggtctcgatgttcatggtctggtccactcggttatcgtgccagtcgcacgcagatacgccctccgcaagggaaggcgcatcgtcatacgtcctgttacaggtaggctcggcgatccgccgcatgattcgcccttgccgtgccgctattcccagcgacaaacacagatcgctttccggcggttccgtggcgtgcctcgtagcgttctgcgtcgcgcttgcgctgggcgagcttgcggtcatactccgtcgtccgcaggtccatcacgcttgcagtccgggtgaactggcaaaagcggcgcttggtgcgggtgcgttcgaggttagcgttgccgtgcatagtggtgcctccattggcactgtgagaaagcgaaaacatacagattgaagcggcttctacaggccgggctgcaatccctcctgtaagccttgcagtagtcaacggaacaacgcctatcgtgggcgcacactggtgcggagctaccgctatccatcgaaccgtgaagccgcttcaatctgtatgccccttcgggttgtcaaccttactccgggcatacagtgccatagtcaccgtgtcccgtaggcttgcacgtatccctccagtgagggtgcccggaactgccccgagctatgaccggcttcctgtattccgacaggttgcttcccgtggccgactctcacggcagatgggaaaccctacccgttagcagtaggtatagcggcaccagtgttgcaagtctggtggattctatgggcctttgacatcccagttcatccggttatccgctagtgctacgttgcagcttggcggtccacctagagctatcccattagctccgtcgcaggcttcccgttacaccctacccgttagcggtagtcttagctgatccttcagccttggtgcctatggtagcgcaccgtttgcatcttgtcaagccctattgtctcgactgggcgtcctgtcgccaccatcctaccatgtaagccggtagtccgctagtagtcgctccgcctttaggcttcctgaccgttggtgcatagtagcttactcttggcttcctgtcaagcccggtagggtagctcctcgcataatcctaccagtagctaaggccgcttgcccttgtcgtctgcccgaaggcgtcccagcggcttgctcatagcttgttactcgactgaccactagcttaccactatgctaaccgtctgtcaaccctcttggctgtcaatgcttgccgtgtggcttgcatcggcgaccgcagggaggatgctagtctatagctaggctatctgtcaaccccttggttcacttccggctaaagaccgatacgattttcaggacatgccctctgtcgtatgtgtaccaaaaggaaaacgatacagatgccgccctcccgtccctcagtgcgtccgcatcatagcccggtagggttgcccctgtcaagccctgcgtgcgccctgtaggcccgctggtggccccgtggcctgcatccaatgtgcggcccgtgcttccaacgtggagccatcatcgcacacccattctgaaccgtagctgaacaaatccagccgccttgcgtgagctgctgtcctgcctcaccagtgcgccggtgtactacctgaccagcacacctccacgcgagaggagagaggaacacgcgcccgcgtaacgcccacgcacgcgcacgcacaggcacccacaggcgcacgcgcgcatacacccgcacgcacccacgcgcgtcacgcgggagggcgcatgggggcgcacacgcgagctttgattggagtggcccccgcgcaattctaaatcaaaatttggtccagctcccgatcagcccgtcttaagcctaacgatgggcgcagcggagtacatgtcgatagcgcacgcggcagccacggccttagccgcagacttgctcacatggtacgctccacgagcaatacccgcgccgctgccaatgaagatcggagcgtcatcaggccaagacttcttaccgctaacgactgtcgcctgtccgtccttgatgataagcacggtggagctaccactgaccagcggctcgatggcttctccgcctttgagggcggctacaacggagcggaggacgtgaatctcaccggctacggcgcagaagaccggaccctccggggtttggacccggagagccttggtcatcgtgcccttcatgtcgtccgcagtgacttggctgtcggcatacaggtgcttgccgtcccacacaatggtcgtcatgcctacttctccaccttgcagcgccaaccgcaggcttgcttgtagccgtcgtaccacgcacgcagggcgcgcttgtccacgttgcagagcttaacgtcgaactctcggtcgatagcgagcttcgctacgtcggagtttgacggattctccttggtgaggtacgttacggcgcaatcttcaaggtactgcgcgggcggagccggtatcgtgacgcaggaggtcagcgacatcagcaggaacaggctcgtcagcccactcaggactgcgggcaagggcttgatcgagcgcggcatgcgcgttctccttctcgattactacggttttgagttccttagccgcagtggtagcggccgaggcgttgcccgacgcctgctggtagtcctgctggacgttggctcgggagttgcggaggtgcagcgagtacgcggacaggaggattacggccgcaagcagcagccctccgatcagcaactcgattttacggaagatagacataaggtccgtccttcaggcacatggcctgctcctcgtaccgtcgggtcacaaggccgttcagtaccatcttgttggcgtaaatccaccggggatactggttgcagctcccacggcggtctccggcgttgaccttgcgaagcagggtcgatgcccggagattcggttcacccacgttgaagacgaaggacaccatcgcgtcgtactccccttgcttcaggggaacgcgcacgttgcgctggacagcccgctccgccacgcggaggtcttcggcataccactggtcgcactgctcgtgcgtggcccgcatgccgcgatacacgcccttggtatggccccggcagatggtccacggcgcgccgccagtggccgggtcagggtaggccaccagccggtagccttcatgggaagcgatctgctgcgccccgtcgagcgagaggtaggttgccccacctcccgccactgcgagggccagcagcgcggccatgacgcgcttgctgacgttcatggtcagccctccgggtccggctcgggttcggtcggcagcgcgccgccaccggggccggacgattccgcacgggactgggcagcggtgatggcagcctgcacgcgcgccacgtcggcgctgaacagggtgcccagctgggccgcagtctgcgggtgcttctcggcatgctcgaccagagccagcagctcacggacgaggtagttgccacggccgaacaggccggtgtagttggagaaatcggacttcagcatgttacctccggtaacggtcaaggatggatggacggcctgcacggatcggccctcgtcgggtcgccgccttcatgccggttggatcgttgatccagtcttggaactccttctgcgcttgcttctcgatggccttgttctggtccagtgcgagcttgctcacccagtgccggacgctaccctccagcgcgtcgattcggtcatcgtgcgcaaggctgccgcgttggctggtgatcttggcgagctggtggaacagagaatacaccgagcgcttgccgctgttggcgtgccgctgcgtgtactcgtgatccatttcgaccacgctctccagcacgacgagcgagccacgggcgatcacaggctccaaggttcctatgatgcgggcctccttgttgccggtcacgaactcctcgaccagcgagccgttccacttctcccgcaggattggcaggaacaccttggcgaaggcaccgtggcccatgttcttctcgatggagaggacgttcggcttgtacttggcagcgatttccgcgaggtggcgcaggccatccccgtcgtagccgcccggaaccgcgcccactgcgagcacgtacacggtggagttgaggaagccggtcactgcgaacgcggtctcgtctccattggcaccaccaccggcagggtcgatctgcatgtggacgccctgaagctccgcagtctccacggagatttcgtgcggggccatcatgatgaagccgatgccgctggactggaacgtgcgctggtgctgctgggacatgccgcgagtgatcgtcagcgggtagcgggttccgccgcccggaatcacgatcaggttctccgtcttcagcgggaagcgcatggcgtccatgagtctggtgttcagcatgtagttcagctggaacgaggacgggcctcggtccttcagcttcgcttgcagcttggcctcgtcgtaaatctgctcgtcggtcggctgcccctcgtcgcccatcgggccaccgccaaaggcgagggatgggtctgcttcgaggcgctgcacgatggacggggccagatgtgggccgtacgcctcacgctgtgccggggtcgggtagcggccgggccagatgcgaacgtcgaagccacgaccggggagcgtgttgtagatgctctcgctggtctgcggcgtgccgaggtacaggatgcgtgccgggattcccggacgaccagtacaaatggcggagaactccagcgtgatgttcagcagcagctcgcggttcgcggcagtgcggctgttcttgttggattctacgtcgtcggcgatcagaaggtccgcgcgcttgccgggcaggttgccggtgacgccgatgcacgccacggagggcgagcggtcgatgcccttcaggctgtgatgcacgtcgaacgcctcgaccgaggtgcggtcgcccgcgttcttgtcagggcgaaggcattcgagctgcggcacggtcaggatgatgcgctggatcagcgtcgccgtctcgttggcgttggtgccgcccgccgaaatcacgaggattcggtgctgcgggtcttggatcagctgccacacagcgaagatcgcggtgatcgtggtcttcgcctcgccgcgctgcgcctgcaccatcaggttgttcggcccgaattgcaggtagttggcgatgtcgtactgcatccacgtgggtgtgaagcccagcaccttcatgatgtcgcgcatgaagacggcgaagtgcgcgtagtgcttctggagcacagccagtttcttgcggcgcagctcggccgcctctgcggactcatgcgccattggctacgctccccggaaagttaacgatgttgtccagcgctgcttgcagctcggcctcctcggcctcggacacgtccttgttctccagcgtatcggccaactcgtcgagcgccttgttggcctcgcgcgtggcttggatgttgttgtccttcaggaacttgatcgcggcgttgatgtcggcagcggtacacagctcatcgttgcgcagccgctccttcaggaccgttgcgacgatgacgtgcagctcgccgagcgcgccttcacttgcgggattcgccattcttgtctcccatgatcttgcggtgttcgcgtgcgcgccagtagaactgtgcgatggcgtacaggatggcgagcgtggtgacgatggctgcgccataggtgctgatgaagttgaggtacaacgcccccgccgtgaggggcgaggtgcggacgacctcagaagccagtgacggcggggtcattatgttctcctataggttagggccagtcgtcgggattgccgacgagcttccattgcaggcggttgacgttgttcatgcctaccgcgatcaggtcgccggggattcccgaggcgatcacgtgttcggttgcgaagcgctcacgctgcgcgcgtacgcacaggttgctgccgttcttgtacgacaggagcacgtcgctctgcgtggcgaataccgctcgcttctcgtccatgcacaggcgcggggtggtagcaccggggatcaccatagtctgcatcgaagcagccaccgtgtcataccagtagaacttacacacgccgcccgccatgtacgccacgtgcgggcgcatggtctggtcaaaggccagtgcgatctgcgtgatccctgagtcggtcagcacggtgacgggggcaacgccgtcgcggtaaacgacgacgctgctgccatcactctcggcggtccacagcgcagcttggaggttgtccactgccgcgttgagagtcagcccgccctgctcgaagtcgatgagcgggcgggtgcgccggttctgctgctctacccagtcaccacgttggatgctttgggagacagtagggatcatggcgtgtagcgactccacgaaacgcgcatgcgcaggttcgccgtttccgatccggtcttcgtgacgcccggattgaagccgacttggaacggcacgcacgaactaaggcccatagccgcagtgatcgggccgggtggtacgttgttgatcgacatacggcacaccacatcgcggtagtacgtgccgggcacgtaggcaacgtactggatttgcagatcgctaaagctggacatgttacccggagggtactgatccgtgatcgcgccagtaccgtcgccggtgcctccgtagaagtagtagcagccccacacgtaatccgaccacgcaatagcagactgctcgttgagcgagccactgcgcccgagagcgatgggcttgcatgtcacagtggtgctgacgcccttaatcgtctcggtagtgacgaccggcgtagtgtccacatacatccgcagctcgtaggtgaccacgagaatctcgtccgacagcaccgtgatggtggtcgggttgccggaggagtccttgataagcgcgcgagtcgtaagcgggtaagtgccgttgttgctgttgtaccacttacccccaagctctgacaatacgccggtggcagtgcctgccgggaactggaactgcactcgtgcgtaggcgtagtacggagcggtggacgtgccgccagtctcgtaactggtgcggcccacctgcgctacctgtgcagcgagtgcggtgtcagtgaacgcaggctcggtgcttccgctaccaactgcaaggtagctgatgacgttgtagagtctctgcgcgtagccgctgccttggtcgccaaacgcgtccatgccggtatcggtaatcaggttgttctgccagtccgccactacttcgagcgagtcgagagacttgcccttgctgatagtgaacaggccggctactcccactttgttgtggatcatgcgaagctccatgagacgaagccgctccgaatcaaggcagtcgcgtcgagcggctgattgactacggggtgctgcttcagggtgaaagaatggaaggaactggacacccgagccgtctccgggtccgatgtgtagtccttacggatggaccggatgtcgaacgagacgaacgagcttccgtacagcgccgattctggatcggccgtgtagtcctgccgagagctgcgaagttcccagcccacgaacgacgaaccaataccggcggaatcaacaggcggtagcatgtcgatgttgctgtaaccagcgaaactgctggtaagcatcgcggcgtcgaactggtagaagctgtagagcttcgacgtaacgtagatgccctgctcctcgattcgcccggaccagtaggccacacggttcaacccgtccgtgaccttgatgctcaggaagtaggagctgtcgtcgttctgacccagcacgtacttgtggttccacttaacggtgtctacccacagcggcttgttctgcttgctgcggaatgcggacaggaccacctgcacgtacttcgtgtccttgggcgctgcgccctcggcgacagactggtgccatgcgccgttgctgccggaggaaaccatgttgccccagttgcgttgcagctcggtcccatcctccttgcggtagatgagcgacacgcgcgcaccggccttgcccttggagcttgcgccctgctggacctcggcggtgcatcggatgtagtcgttgaccttggcaggaatcagcgggttcagcaggtcgctgccacccgtcttgatgtcggcgaagcgcgcgctgtatacgccgctgtcggtatcgtagtcctggccggtgccaatcgaccagccttcgccgttcgacccgccgcccggcacccacgtgccgtcgtcgcctgcctcgaagtcgccgtttggcacgagggtttcctcgtccacgacttcagtgaaagccgcccacttgacgacgacttccttggtgatattgtccactcgtaccgcagcgcccggagggagcgtcgattcgatgacctccacggtgcagcggccgactgggttgttgatggacaggcgagactcgtaagcctcgcccgccgtgtacccttccagcacgcccgtcaccgacaggccatctgcaacctcgtccgccatcagcggtcggccgtacagcctgaagtgattagccatgcctactccttagccaagtcgcccgagagcaaccatgtgttggtgtcgccgtcgatgcacgttgcagtgacgacggagttggtgccgcgagttgcggcgatgcagccggctggtacttcgagagttacgcccgcgtcgccggtgatgaccaccgggcctgccttctgctgcacgctgaagtagctccccgaggcgagcttcgtctcaccgtcgccgacctcggggatcaggttgatgttgacggtgcagcccccggcgtacgtgcagcgcacgagtccgtactcggtagccttgtcggcgtagtaggtcggaccctctgccgggatgatcggcacccgcaggctcgtagcggtgatcggcgcaggcccggtgtagggcttggcgtaaccgcgcagcacggcgaaccagatgcttccctcagcgggaaccgtggcgaagcggatgaagctgggatcggttccgtcagcgagcgtgacctgatagtccacgtccggctgcatgccgataccgttgacgtacacgtcgtagaagcccgcgccggatacgtccgcgcccaccatgtcgaagtcggtgtcgtccgcctgatcgccagtccaagagccggaccagacgcgaggggctacggacacgataccgccagcggccagaagttcgaggacttccttgtaaatctcggtgatgatcttgttcaggtccaccaccacgccgacttgctggtcaatgctaagggtggcgatgttcaacgaatcgaacatttcctgaatgatcttcagcaactggtcgttgcttaggttaaggttggtcttgctgatgatgctaccgttaacgtagtcaacgagcatctgctgcaccggagtgctgcggtagatgtagagcttgcgcccagccgcgacggcaggctcaactcgcacggtcgaggagttctcatcctcggacagcacctccacggtgtgagaggtccggtcggtaagcagctgcgtttcctcgtccagaatgccgctcatcgcgtacacgtgggacgggtcgatgtagccgcccgtgaagctgatttgccagtcggtagtgacgccattggcgtcgaatacgtccgtcgcgtagcgcagctggggatcgggaactgccatgctgcctcctgtgtttgtcgtatgtgtaccaaaagtcgggccgtccttggcccgccagcgttattcctccagatgcgccgccgcgcccttcagcagcgggatcacgtacggcaggcgtccgcccggcagcacgtcggcaaggttctcgggacgcccgctcacgccctgcgcgaagtcgttgatgacccctagcgccggggcgaagctgccacctacgatttccttccggttgccgagctgaccgcccgcgagctgccgcacccagtccggggagccggtgtcggttgcgtgctcgtaccagccacccgccacacccgtccccacttccagcacgtcgccgaggaaggccgttgcgctgatgtagttcatggtgctgcggcccatcgccagaggcgacagtgcatcctcgatagcctgctcgcgctgctcctccggcaggaggacagcacgcgaagccacacgcagggcttgcagcggggcaaccacggccatcgccgaagcgatgataccggcagtaccccatgcgccgtacaggcccatgtagcgacccagctgcttctgctgtgcgaccagcgagaacgtgcggtgctggaacagcatcttcagccaaccgttgtgcgcccacttgccggtctcaccgatgaaggtgtcctgcaagatttggttcgtaccacggtcgatggcgttgtagaacgcgagccacgcctgccggtcgtgcaggttctccagaccacgcgggtccacagcctccagcttaccgtccgcgccccagcgcaccacctgatcctgcgtctgccgcaggcgagcaagcagcgtgtcgtcgaggcccatgtccttcagggcagtatcggcagccttgccgtcccgcaggaacttcacacccttggcgatcagcacctccgcgaagccgcgctgctgcacagccagtaccgcgcgctgtcccgagaggatgcggttggcgttggcagtgcgctgggccagagcggtcaggaagcctgcgcgctcggagccgtacagcgaagcctgcgtgtccatcgagttgaacatgtgcaggtcgtaacccgcaaggccgaagccgcgtccgctgatgaactcgaagccgccgaggatgctgttctccgggtcttcgccgcgcagcagcttgccgatttccgcacgcatgcgaggagcgattcggatggcttccgccacgccagcagcgccgacagccgggagaccgttggagtattccgccgcttggttgatgcccgctccgcccagctggatagccgaggtcagcagccgcgcattcgccagaacagtcggatcgcccgtgccgataacacggcccgtgaactcggacatcacctgatcgaacgcacgcagctccacgtcgttggcaccagtaacctgcatggccttgcgcagcaccgagataccggcgtcgcccatgatgccgtgcttcgccagagcgatgtcaccagccacacgacccgcgtacttgcggtagttgtccatcacgcggttgtccaagtagtccatcaggcggaactcgccctcggcatccttgtacttgcgcgtcacgtccaagtcgatacggctcttggtgtgcttcgcaccgccacgcgagtagcggcccatcaccttctggatttcctcctcgttgagcgacagtgcgcgcagggtgtcccgcagagtgtcagactggttatcggagaacaggttgtccggcgcacggttcatgcccgcagcccgctcctcgatccgctccagatacttgatgctcaggtcgtcgaggaacttgtccccgtacagctcgcccatcacatcgaactggtcacgcagtgcctgccggatgctctcacggcgcacgcgcccagccgcagcaatcttgccgcccagccaagtgcgggactcgtaaccggccacgtcaccatcgggaaggcgggaagaacccaccgtaccgacagcgcgctgctcggcagccatccggttgtagccttcgtccagcgccttcgccatctgcttgatggactcgtgcgcgtcggcaatctcgcggcccatatacatggtctcgcggtacagcttcacctcgtactcgaactcgctccgcatcttccagccggtggcgaagtccttgatcgcaccagccttgcgcacgtcggcgcgccacagccggtaggccgcttcccactgacgcgggcgcgaacccatgaacgactcgaagcgaccgcggcgatccatcgctgcggtgctatgccgaccagccgcgccttccgggttctccagcagggtgacggcgatcatgcgagcgaccggggactgcgacgacatgagcgtggtgctcgtcgcctccagcccgaacttctgcatgatggtggacagcttctccgcgtcgatggcatacttgccactgaagcgctcggcgcggccgatcacctcggcgacttggattcgggtggcgctgtcgctgatctgcttgtccagcccggtgcgctgcatgaaagccttgcgctcgcggttgttcttgaagatcgagttgaccagcatgccacgggtctgctgcgaggcagcctgcggagagcgaatctcctcacccaagttctcaccgaccacgttcatcaggcgctccaacgcagactcctgtccggtcaggcccagtacgcgggcgatcttgtccttcagccattcccacgcggtctgctgcgttgcgcccggaggagcgctgatgttgcgcagcactgcctgcacgtcgcggttggtcagaccatacgacaccagctcgtcggtgttggcgaggaagcccatgcgctgctgatccacccggccctgcatcgcctgagtcatcaggttgcggtccgcctcggacaggttggcattgacgtgcgtcagcagctcgtccatctgcgccttgaagttcgcatcctgccgcagcgagcggaaggttgcggcgtgtagcatttcgtgcagcaccacctcggcgttgtgcgcagagctacgcatcgccatcgcgttgagcgacgggttgtacccaccggccacgttcggctggttcgggaaccactgagccagctcggcgtcaggagcgatgcggacaccattcaaccgaccgctacgcttcagcgtgttggcgattgcacggaagtcttccggcacgttcttcgaggattcgaggtaacgcagaatgtcatcgggcgtgcccttgataccgctcgccttccacgcacgggtcagcagcggatcggccggagcgttccactccacgcgcccgcccacgttgtcggcgtagttgccggtgctcgggtccacgttctccacgtcacgcgccagtgcgccggtagcgttcgaggcagccgaggcttcctgcgccacgtccgggcgagcgaacaggcggaagtcgtccggtacgtcagccatgcctgcacgaatccagtccatcacctcggctcgcgcgagggagtgaatcttcgcgttgagcgccaccgggttgccctcgcccacctcagccacggcgcgtgcgcggaggtccgcattccactgctcgccgtacatggcggcgttgccggaggccaagtcgatggtggccttgtcgcggacagcagccgcgctacggataccgcgcaggttcatcgccgtgccgataccagccgagaaggcggcgtcggtcatgaagtcggcgacggtgcggttctcgcccatgcccaccagtgctgcatccgtgatgacggacgcggcggcgttctcggcgacactcgaagcgatgcccgcagccacacggccttcagcgaacagagccgcagagccgacgcccagcgcgcgcacaccaccggaggccaagccgccagtcgcccagttacccggatcggtcaggcccgccacgaggtcgtagccgaagctgccccagccggtctggttctccttgatgcgcatgctgtggcggcgcatgtagatgcgatccgtcacgtacgacagttcgtccggggagtatgccgcatcgcggatgtcctccagctcgtcggcggtgtagtaggacttctcccactgcttcgggtcgtacgtccaaccttccggcgtcacctcgcggtcacggctgagctggttggtcaaggcagcaccgatgccgctatcgaacgccgcgccccacttgtcgaggaacgacagcgagtcacggaacgcaacctcgtcccggtcggactgggtggcagcgatggcagcgcgagtgttgcgctcgttgctctgcgtgtcgatggcagagacttcttgtcgcacccaccacgggaccacctcgtcgctaccgcgcacggcctgcgccgcagccacgccctgctcggcggtgccaccggcgatgacgttctggcccatcgccagttcgcccagcccttcgcgcaccttgccgatgtactccttcgtcgcacgggcgagaccgctgcccgcgccttcgatggcatccccacgccatgctgcggggatgctcgccccgctccacgtctgcgtggtcatgtttcctgcaccggcccaagcggcactgatgccgccctgactggccgcgccctgcggagccacagccggggcagcctcgccgcccagtacagccggagcgtacgccgcattcttcggtccccagttggcacggttggtgccgccgtggtagatgcggagtgcggtcgtaacgtcgcccttggcaagctgcatgttctcgcgcatgatgtgcgcgtacatttcgaggttgtcttggaagttgcgcacgtcgtacttcttgcccgtgcgcgcttcgatgacggcctgcgtctgcggcatgacttggaagtcaccgcgagcgcccgcctcggaagtgatgatgccctgtgcattcttctgtgcgcgcccgttgccggattccacgcgccactgtccacgcacaaccgactccggcactcccgcgtaagcggcagccgcagcgatctgctggtcttgggtcagccccgaaagatcgagtgccattgtctaattctccttagagtttgggttggatggaaatgctctgctggatgctaccgtccggcatgcggacgtagccttgcggcaccgggaactcggtgcgggtcgcagccttgcggcggcgttcgtactcggccttgatgtcagcgccagtgacggcgacgaccttccagcccctctcgccaaccgtgttgacgtacagcaccggctctccggtctcgctatcacgcatgcggaacacgtcggccttcaggctcttgctcggctccacgttgttggcgcggagggtggcgtcgattaccgcttcgattgcaggcccggtctccttggtgtccatgaagcccagccatgcgccgacgctgccgatgacgtgaccttcgtcgtcacgcccgttctcccagtaatacttgcccgcatcctcgccgccgtacttcagcttggcgagattgagcgcagcagtgataccttcggaggacgtgtcgagtagaccaccggactcgttgaccgcacgcacgattgcacgcgcagctgcggcccggccggagtcgcccagcttgttgccgaagtagccgaagtaggcggggttcgccttctgcaacacgtcagcaacgcgcgcctgcaacgcctcggattccttgcggctgcttgcactgaactcggtcgggtccgcggtggtgatttccccacgcgccacctcgtaggccagctcgaagttcacgccggattcctccagcgcttgcagcttgttgaacatcgtgttcacgccgtcgccgaagtacagggctgcggtggtcgcaccggacagcctaccctcgacgggattgccgttgatgtcgatgcgcttggcagtcgtgttcttcagcatgcgccactggttgtagaggtcgcgcgccgcgtcgttcggctgctcacgcaggaccgcacgtgccgtggtctggtactgatcggccacgcccttcagcacagcgccgcgtccagtgttggcgttccacaccagctgcgacatcgccactgcggggttcgtctgcaaggtctggttgaagccctgcaccacgttcgcctccagcagctccttgtccacgcccggcacgttgatcgtctgcgagtacgtgccatgccgccacgagtcgatggccgcccggatgtcctcctgctgcgccgccagcttcgcctgctcggtgttcgccgccttggcagcagccgcacgctcacgcagcaccgcttcctgcgcgcggatgtgcgcgcctgcggactgggccatcatgctcagacgctgggtgccggagtacagcggatcgtcgctgccggtcgcggccgcgtagctcatgttgagctggtcgatctgtgcctcggtcggcttagcaccgatgccctcggcagcgtacagcgacacgagcgccatctgctccgcagcctgcgggttgttgtccagccactcggacttgtactgcgcctgcttctgcttgacgtacgcctgcaactgcaaggcatcgtccgggtccagcgccgacagcacgccacgctgactgaggaacttcagcgtgtagaactcgccacggtcagcagcgccacgaacgaacgcggtcatcgccgccttgtagctctcgtccgtctggtaggcggaaggcgacagtccgtccagcaggctcacctgcgactggatcagcttctcggcctcggcttcatcgccgggtgccttgttgcccagcagcgccacgcgcttcgccatttcgttgtagctggtggagttgctgctgttgctcgcgtactgcgccttgaccagctcgctctgctgccacgccacgcgctccttggtgtgcaggtccatcagcggaccggcgcggtccatgaaggtcttctgcaacacggcgtctgcgtagccgttgcccgtcatctgagactgggcgagcctgttgaactcttgtgccatcgcttccggcggcagcttgcgcagctccggcatgcggtggatcaggtcttgctccatgtccgagaccgaacgcagcacgttgtagttctgcgcgccaatctcgtagttcgtgggaccgaacagcttgctgtaccacggctgctcggcagagatttcgtccatcgtctgcccgctgcgcgccgcaacgaagccatcccacatctgctgctgctccagcgccttgcggttcggggcagtaatctcgttcaagaactcggggagattgctgtccggcatcgtcatgccgccagtaccggcgaaccagtcactgccgctgcgtaccgcctgtagcggggccacgccaccaccttgcacaccggcctgcggaacggcagcggtcgcgccaagcgaaccgccaccgaccgtctcggtgctgaaggtgatcgtgcccggatcaccaatagccattaccatgcacctcctgaattgctcccgctaccgaaccagccgaggccggaggtagtcgtggagaagttgtcgtagttgttgccgaactgcgtggtgatcttcgcgcccgttccggtggatgcctgtcggcccgtgccgtcgttgtacccgaaggtgctggacgcccacgacttaccgccgcgctgcgaagtctgctgccacgccgacatgccattctggatgccggagtcgaagctcttgctcatgccttggaagtcaccgttctcggcctgccacgtgccaaccgcgaagtcggccacggcctcgcctgccatcggcccgccgaagtaggttgcgactgcaacgccaatcagcttgcccaagcggcgcttcatgcgcttcggctcgatgtgctcctgatagtcgaactggccgaacgtccggctgatgtccatacccttgtaggcgttcgccatgatctgcgccgtctgcgcagcgcctcggctcgacatgagctggatcgcgttctgctgcgtctcctgatccatttcggactgcaagcgcaccatcgtgtccatgaggtcggcggacgaaccaccgacacccacaaacccggactgcgccgcgagggcaccgcgcgccgcagcgagctggacctgcgtgttgaggcccgccccttgcttcgcgcgcagctcctccgacagctgctccatctggaagttgtactccttcgaggccgcgttcaccttcgcttggttgttgagcgtacgcatgtactccgagaagttccccttcgccacttcgagggcgttggtgttcttcgtctttgcctcagctgcgcgccagttcgctcgtgcaacccgcgtggtgttgttggcctgaaggatagtgtttacgctacccactagctaaccctccgcacgttgttgaaagtctgaccaacccacgacaggcccgtcactcggagcgggagccagtccttggagctgatcgtgtagctgcactcgcggacctcgcggcccacggggatcgacagctgcccggaatacaccggctgctgcccgaccaagttgtcgctgtcgccgaggatgcggccctcgaagtcgatgctgctctgcacccggttgcgcgtagcgaccacggccaccatgcctgcggtgttctgcacgtcggcggtgacgcggttgagtgccatgcggccgtccagaacagcctgtccgttctggtctcgcgggaacggattggtcggagtcaccgatgcgggactcaccacgccgaactccagcgccgcagggtcgaggtcatcgaactgcgacaggaactccgtgatgcgcgccagtggcgtgcccagcaggaagtagtcgctcgtcgcgttgaccacgacggagccatcggccacaccgttctccgtgcggttcgcgtacgcgatgcgagagtcgatgtacccgtgctcgtccagctcgcccttgaagtccagcacgtcggccaccacaccgcttgcgcggccggtgaacacgattcccgacttcttgaacacgctcacgccgaggatgttccccagcgatgccgcgtactggaacttgctccacgcctccagctgccgctgcccgttgttcttgttgtcctcgtagcggtacaggtagaacgtgctgggctgattgcgggtgcggaacagcaccacgttcggtgccgtcaccgtggcgatctgcaacggttctcccgtcagccagttgtcctgctcctcgctcagctcgtcggtcactgtctgctgcccgttgagggcacccacgcgcatctggtgcaggctcacgccctcgctaccgtactgcgagtagaagatgaagttgccggaggtctgagccttcgcgtcggtgctgtccttgtttgcgctcaccgcccggatcagcggagacttcggagtcagcagcgcatcgccgctcacgccgtactgctgccgctcaccgaagatgatgaggttgccgttgtagagcaccgcatgccgcagcacgtcgccctcggaaccgaacgcgaacatttccaccgggtcgtcgtcggcgatggtcacgacgcttccgcgccagaagtcgaggtagtccccgctcatgctcgcattgacgtagttcgcactgcctacgatcagccggtcttggaagacagacaacatcgtgatgggcttgtcgatgaaccacgggatcggagaggtgaggccgtcaccgaccttgcgctcgccgtatgcgggatggtccccgctcgccgggaagatgctggtgatgcctgcaccgttgcgagcgatgcacgcttgcccgttgtagatgtagagctgggcgacaaggttgtcgatggtgcaggtcacgcccgcagtctcgaaccagtccaccgagccgtagcccgaggtctcgccgctctccagctcagcgcgcaggtagtacgcctcgtccgcgcctgcgccgctcgggcgcacacgaatgatcttgccgtggaagtggtacttggtcgcgtaggtggcgtcggtgatttcctgccccgccgcgaagaacgtggtgccgtcgccttcatcgtccaccgtgatgtccacgaactggtcatcgtcgatgaggatggaacccttcaggtaggtcgaggacacgccctcgtcaacgagcaagtccgacaacttctcggcgatgtactcgggccgggtctgctcggcgctcgtgacgatccactcgttgactgcggagttgtactcgttcactcggtcgttgacgtgcttctggtacgccgggtccggctccgtgccgccgggcaggtagaacgggatgtcgctcgtgtcgagcgtgccggggtaggcagccgtcaccgtcttgtacgtcacctgcaacgtggtgccgtctgctcggtgcaaggtcacggtgtaggtggtgttgaacttgccggtgcgaatccacgcggcgagccggtgcaggttggtctcctcctgccagaggttggtgctggtcgcactcggacggttgtcgttgcccgcgatgtagacgtaactgccgatggctgcgagcgacgacgccccgcctgccaccaatgtgttgacccacgagctgttctcgtacgtgatcgggatgaactgctcgcccgtcttgtcgtacaggaacgcgaagctcgcggagccgagcgccgacgccttgcggcgatacagcagcgcgtactcgcggccctcctgcgtgaagtcgaacacgtccatgtcttgcagctcgacgcgcgctgcctcgctcagggccagaggcagccgggcagcgaagcgcgtaccgcgacgacgcacaagcccttcgacgggatcggacagaatgttgatctgctcggtcgtctgtcccggtcggcggcggtgcggcggcttgccgctcacgccctgcacgatgtccgggtaggttccgcctgcctttgccatgatgcctccttagccggggaatgtggtgtggctatgccacggatgcccgctgtaattgaacacgcgctgacgcagaacgtccacacttgcccgcgcatacagagggtttgccttgatctgccggatgtgctccgacttcaggttgatccagcttagctctcgctgttgcagaatcttctggtacttggtgttgtcgccgtcgaagtccgactggaagcgcagcacgctgtcgtcgcgcacgaacatctgcacctcgtaggggcagtcctcgaagtccagcagccgggccaccttgacggtgacggggccatcgaactcgtacttgttgcgtgcgacatcgtacagtcgtcggccgcgctgggccacccgccgcacgccgcagtgcggcaccgggtccaccttcagcacatcggtcgggaccatgatgtacttgctggtggcctgcggctggagcttcaaccactccacgttgaaccacagcgcgagcgacgaggtgtcgcgcagcacacggtccacgaggtcgagggcatcatccttgtacgggtgatcttcctccagagtgttgagcttcgtttcgcccatcgtcttcaggcaggcgttcactacgtccaacttggtgatgaacatgatgcctcctagggaacaaggcagagagagcgctgtgctctccctgccggtggatcagtcggccgcgagggtcacggcggacggggccagctcgaagtcctgcgagccgttctcgtcatccttcacgcgcacgacgatacgccacgcatcatcgcggccgaagacggcgacgacggtgcccagcgtaccggcctcgatgcccagcgacgcgatggcggcggtgatcgaaacgcggttggaaatctcgaaggggcggtcatagaccattgtgtcttactccttggtagagggcgcagtttgagttacccgagggattcagggactgcgcccggatggattaggcagccgcgtcgatgcgaccggccagttcgacgcggttgaagccgacggcgaacgacatccagctgtccacgaagaagcacttcgaggcgtcggaccaccacacgctcgactggagcggcagcgcttcggcgatcagcagcgcacgcggcgagaccgccacggccacgaggccggtgaagtcgccgtcgtagaagttgtcgttgtcctcgttcgacagcaggtggccttcgaccacgccgttcggcaggttctcgctcgacaggaccgggacgccccacgccttgaagaccgggatgccggtcagccggttgccgtcgctggtcaggtactcgccgttgacgatctgctcggcctgctggagggtgtagaacacggtcgggcggacgatcaggacgatgccatcgcgctgcggcttgaccttcttggtctcctccatttcggagaacagcttgccaatggcagcgtacagcttggccggatcgttctcgtcaccggcagcggcgagcacgacctgcgtggcaccgaagtggccctcgggcgcgcggccgttcttggtgaaggccgaggtggtcatggcggcagccttggcagcagcgatgctgatggtggcgtccacgaactcggcaatctcctgaccctgctcgacagcgatttccttgcgggtgtcgatgtcggtgaagatgtcgtccagctgccagatggagtggcgcgacagcagcatggtgtccacggtcacggacgccttgctgaagtccacctgcgtgccgtccggcgcgtcgccgcgcttcagcttctggagcttggtgcggccgatggccttcttggtcagggtgttggtgcccttgaccggcttgcgcgggaagaacttctccagcacggagctggaaacgaaggtgtgctccacgtcgccggtgaactgctccagaatcagggcgttctcgttgccctgctggttgatctggttcgggaggaccggaacggtcgggaagatggtgctcatgttgtagtgatgctcctaggttggttagtggatgacgcgagcgttcagagccttcagctcgtcggacttcgctgcaccgctgatgcccagcttgtccaccagcttgcggtactctgcacggtactgctcgcgggtgagcggggcgacgccctgcaacgactcggacacggcagccggattggtagcgggctgtccctgcacggagacgttcgggttcgaggacgcgaggctcagcagatgccgggccatcgcaacggcagccaagccgcccgaggacaatgcctcactggcctgcttcagctgatcggcgggcaggttggtgcgtgcgtactgctgcacggccttccagttcgcctcaccacccacggcctcgtggaccttggtgacggtttccttgtgcttcgcgtcggcggcagcagcgatgcgggacaccgagtccttcgccaatgcgaggatcgggcctgcgcccttggccttgtcgcccagcacttcgatcttggcttccagcaggtggaagttgcccttcgccgcttcggtcagctcacgactgttgatgtcgagacccagcgtgttgacgaagtagtcggccgcgatgttcaggccgttgtcgccgtagtccggcagctcggcaggagccggagcctgcggcgcgctcggtgccggggcttgcggttgcggagcgggttcgaggttcagcgcgttcgggtcggccgctgccggggctgcgggagcctgcggctgcgccggtgcggcgggctggttcggctggaccttgatcggatcgtcggcggcaggcggctggttgccgttgggctgcgcggtcgagacgatcacgtttgcgttggggccaccgcccggaggtgcgttctgactcattgggtctccatgttgttctggttgtcgatctgctgcgaggcgttctgcatggcgagctgctgctgctgtcgcatctgcatcatctgcccgaactcctcctcgctcagaacgtaggttgcgggatcaaggccgcgcgctgcggcaaggtcagcgatccacgcggacagcttcaggcggtcgagaatctgcggaggcagactcagcacgccgctgatgtcctgaccgaagcccagcagtcggtcacggtccccggtgcgcgagagcgcggcgaggccagtgatgatgacgggttcgatgtcggaaccggcgatgctcttgtcgatcagctccatgacccagtaggccacgggaacctgcacgtctacggcgatgcggctgtagccgccacccagtccaccttccagctcctcggccaccatgcggatttcttccgccgtcacgcgctcggcctgacgagtcaccgccgtctggagcaggaagcctgcgccaatgcggttgatgtagagctgctggatgttgaggttggtctgtagcgtgccttcgacgccggagctaatcagctcgatgtcgcccttctgtccggggattgccgcgccgttgggcgaggccacgaagtcttcgacggaagtctgaccagcagggttcaccagccaccggaactcggaggcgaggatcgctgcttggatggtcgcttcgctcaggagggacagcgcttggaagtcgccctcgtagtcttccacgaggccggtgccgtagtcgtcgcctgccgccaagtcccacgtcacagcgcggtagggcagcttctccagagtgtagctcgacgagaagttagcgggcagctgcacgttgtccagccacactgtctcctcgtacttcttgccgttgaacttcacccacttgtactcccagcagttgccatcgtcgtccggcttgaactccgggttgccgatgactgcgccgagtgctgcgggcttgatcgcggacttgtgaatcttctcgcggatgatgagttcgcacactgaaccttggcggtcgcgcttgacgacgtagttgcggaggttcagcacgcgcaccgtgtccttgtcgaacaccatgagcgcgttgcccagcacgatcagcatcttcagcaggtcgtacagtctggcgcggatggagcgcttgtccagctccagcgaggcttcctgctccagcttcgcaagctgggtctggattgccttcgggtccacaccggcctcgctcatcgtggcgcgggccttgcggttcgcctccagccggaagaacggccgggacggggcgaacagggacatcatcagcttgttggcgaggtggttcaccgcctgcgcgcccagcgactggaagccgtgggtcagcggttcggtgtcctgatcgcggttcttcttggggaacagcttcgggatggtccacgaagcgtagcgctccagccggtacaggataccgttgcgcttcccgtccagcttctcgtagcgctggcatgcagtggttgggtgcatcggattgtccatgctcacctcacaggaggtccgagccggaggttccggtcagacgcgattgggcggtcgggacgattcgctggtactgctgccgggtcgtacggcggcgaccgatcaggtcgtcggtcttcaggtcaaggtcggaggttccgagcgtaacgtccacggtttcgatgggcgcactcagcaacttctcggcgtactcgctcgcagcctgctgggcggcggcggtagccatctggtcggccattgcctgaatctggtagttggtctgttgggtctgaaggttggtctgacggtcgatggcagccgcttgcttcagggctgccttcttcgccgagccacctccgacgagggaacccataggctatctccttcgtttggtgagttgcggcgaaccatcctccagctcgaagccgaagcgttggtacagccgagtgattgcccgagaggatcgagctagtgctccgcctgtgactatggcatcgcaatcgttggtctcggccagatgctccagtgtggcgacgaccgccttgaaggagctacctttaccgatccgtagtaccaagtcctcagacaggactagcctgttcttagagtaccaaggtttcactacagagaataccagtaggtagctttcgtctatcactactgcatctaccatattctgtactaccatttccacagtgtactgtggatcgtcacagaggtagcttactgaggagctactatgctcactctcactcggggctaaagacagatacagggcagcgtctagcgccaccctgatccgctctctatcacccgtcgttggtgttcggattgctggactcaacggtgaatccctcctgcaaaatgcggagaactcgtgccattccgatctgcacacctgcctccaagggcgtggtgttggaattgacggagaggacggaacccgcctgtcgctgcacggcagccagttgcttcgggtccagtcggtagatgatcttggtttcggacatgaggtctcctctgtcgtatgtgtaccaaaagggtttgatgcctgccccggagggcgaggcaccctttgtcgtatgtgtaccgaaactccttcagctgaagaagtacggagaatcaatgacttgcgtgaggtcgaggtcgcccatcgggggcggctcggggaggaagccgtaggccgccctgaactcctccagcacgtcgtgccgggcgtacatgtccacgaagacctcccggatgatttcgtacaggcgggctgtgtcggcggcgtgggtgccgtagtcgtcgtggatcatggcgaaggcgtcgatgccttcggccttggcccggttgaccaccagcgtcaggtggctggcgtcgaggctgtgtacgaagttgggggcgatgccgttgcggtgccgggacttcttcacctcgtccgtgctgcggcgcacggagagcttcgcgttgccgcacagcttggtgttgatccggtgttcctcggtctcccagtacacctgcgtcaccgggaagccggacggcgtgatccacttgatgcggtcgtagccctcgcgcaggatcgccgtggacgccttctggagccacgccattgcgtcggctgccgccactaccgtgtcagctatggcgacgcccaggcgcttgctcaggaagcgtgcggccttgtcgtacagcttcttgtccagctcggggaacttgcccgccttcaggtagtcgctcacgatgaagtccgcccagctcgattggcgcgagccgtagggcagggtcatcaccgagcgcttcaccagcgagcgggtcaggccgtggtccagccacagcctgcggaacccttcctcgtcgtcctcctcggcttcaaggatcttggtcacgaggtccgccaccatctggtagatgtcattcggaagcggtgccgggatcaggttggtcgccttcccgcctgcactgtcgcgcagcatcgcggagaagttctgaagtccattgcaggaaccatccatgccgactgcgatgcggctctggaagcgatccccgaatacctgccactgctcgtactccaagcaccaagcgagaaattgcagcggcttgtctgcggtcttccactcgtcgttgttcaccgggtccgcagcaaacgccagaatctggtcgtgatgctcgaccacccacttcacacgatccggcagagacgccttgtcgtatccccatcggtttgctcctgtgatgcagaaccagtccttcgccgacttggtgagcaagggcttgccctcgccgaactccagcagcgccttctgcaagtccgaaccttgcggcgagacgccggtggtctgtacgtacttgcggccacggaagtccacgaagtagacgaagtagattgcttggtagtccacgaacttgcgcgccactcgcatggcgttgtagaagcgattgctcttgctgttgcgcaggcgctcgtcggtgtgccagtcggccacctcgcgcttccacttcttgaactcgcgctgctgggattcggacatgtcctccttggtcatgcccttctccaaccaatccggcttgcgcggcttgggcagctcggcctgcgaaatgatttcctccatgtcgtgaacctgcgccactgcggagacagcctccagcatacggcggttgatccgccacggcacgcgctgcaacgcattgaccgcagccatctcgttgcgcagctcggcgctacggtagtcgtcgcgggtctgagcgtaggtcttcaccatccacggatgcagcctgcgcatttcgttggtatggaatccgccgttgtccacgtccgtccagtccttcggcggctcgacgcacggcaggaagtacggggtgctctcgatgacgaactcgctgatctggtggatcaacttgcgcacgtcctcggtcaactccacgtgcagattggtcttggtcttgcggcggccaccggacaccacgacctcgttcatcacgccggtgtccaccatgcccatctgcgcaagctgatcgacgaggtagccgccgacctgatcgcgctgtgcttggccccactcgtggaactcgacgccgttcttcctgccctgcatcttcatcacggtcatgcggtgcgtctcgttgacgctcagcttgcggtccatgtcgttcatcaggtggtagaacagcgtcggctccgcgtcggcgaactgggtcagcaggtactcgtggtacacgttggtgcccacctgcttcaccacctcacgaccggcagccttatccttcttgccctgctcggcgatgcaagccgccaagcaaccacgtacggccacgaaggcgatagcctcgtaccattcggtggcttgttcttcggcggtgatggccttcccacgcttgtccttccgctccgggtcgtacttcgcccgcagaagtggcacgtgggcctgcgccctgccgatgcgcggcttgtcgatgtcagcccggatacgctccgcaagcggaagcacgaaccggcgatacaccgcctgagcgtaagggttgttcggcgcgccgccgttctcctcgttacgctcgatggccttgcgcatgcgctcttggccgaaagcataggtctccagttcgagttccgcttgggtgagcatgctacctccggttgtgtgcttcgtcgaggactcgcgccagcgcctcgttcacgacctcgcgcaggtgctcgttcgggaacagctgctgggcgtagtcgtcgaacgggatggtgatgctgatcccgatgctgcgggtgagttcttggtgggtgatgtcgatgcggacattgctactcatcggtccgcctccgccttgtcatgtcggattcccttgtagcgcggctcgcgcagcaggccgtacttgctcagggacatggattcgatttccacgatgtccccgatgcagggcagctggtccgcgctgtgcggcacgccgctaccgacttcctgctccttgccttcgccgaggtccacgaccaccgtccacacgtcgcgcccggtcttctctccggtgctcatgttgacgcgcagcactcgcaggtccagcgtcagggtgggcttgatcttgatgacttcacccttcgttcccttgtcgcccttggtccacgtgccgctcggcttgcgcaggatcagcccgtcgtacgggccgctctcgcacagcaggcgggcggcttccatcggcgacagctcctgatccacgaggaagccttgcgactccgcaaggaagaacggagccttgcattcctcgatcttgctgagcgtcgcgggcaagcggcccacgcggtcgaggtaggtcagcgggctgaagccctgctcccactcgccgatgctcacgaagtcgaagaccacgaagaacggttcggtgtactgcgtgccgtccttcttgcggaacatgccgctcacggtcggctggtcgatggtcgggtgccagtattcgccgaggtacactccgatgggagcgaacggcgcagcggccagtgcttccttgatgtggttcgcggacaccacttcctcgccggtgcggctgaagatcgtgatgtgctcggcggcgttggcggccttgaccaccacgcagttgcagccgtcgtacttgggctgtgcgaggtactcggtgcgcagcgcgtcgtcgctggggcgcagacgcttctgcaccttgtccagctcgacggccttgtgtacgatgtagggcttactcatcggccttggtctccttggtcgggaggttgttgcggacggtcagcccgccgacgttcgcggcgatgcggccggacatgaagtccgtgacgatctgaccgatccacagcttgcgcggcaccatgccgttgcggtagccttcccacgcatcggcgatgcgagcgtacagctcggccttgccttcgtcgttcaggccggggaacgcggtgttgaccgcatcctgcaacgcttcctcgtgaccgccattgccccaagcaacggcaccctcgtaggactggatcagacgctgggtgttggacttgtagttcattgtgtctccttgttgaatggaacgaaacctgcgagacccttcatcacgagtatgcagaacgcatcgtcagggtatgtgcgatgccagagtgagttcgcccactcggtatcgaaatgcttgcgggtacgatgctcctctaggaagcgcgcccactcggcctcatgtgggacgtaccgatgcacttggccgcagcgggcgcaggccatcagtcacccttgctgaaccagcggcggatgatgtactggcgcacgaagctgatgagcgtgaacgcaacgccgatggcgtgcgccgacagcagcgggtgctcgggatgccacagcagcggcagcaacgcgatgttcgcgcagtagttgatgctgtacccgatggcgatgttgacccacgcctccttgatggagcgcttcttactctgcgccacgggccttctcctcgcgcagctccagctccagcaggaacagctcgttgatgatgtggtgcgcccggtgccggatgccggtctcgggatcgaacagctcgccacggcagcgcgccgcgtcgtgccggtagctcgcatcctgatagcgctcctgcccattctcgacgtgctgccacgagtgggcggcgtacttgcgagcgccgaaggtgagggtgcggacgacctcggccagtgcgagcggcatgccttggtgcagcagccgtggctgctctttgccgccgtcgaacttcaggcccgctccgcgttcgctggtcggcggggtgcgttcgtcttcgttacggtagttcagttgctcaggcaagggaacctccctatgtgtggtggtgatgcctcctacgctcatcaggcgagtgaggaactgggccttgacgtaggactccttcatcaagccgtcgaagcggacattgatgtactcgttgcagatgctatgcaccacgccggacctaccgacgaggcccggagcggagccggtatagcgaacgcggtcgccacggcgaacatcggtaagtctcatgcgcttctccttatgcgggaacggtgatgtggcggcgctgctcgatgttggtcgtcagcttccgtccgcggctgtggccgccgcactgcgtgcattgcagcagcaggtaggtgccgacctgagtgcgggctggtgccttctgcgggatcatttcgttgtgcccgcacttgttgcagcggtgctcgctgccgtcggccttgtagtacaccgcgatgttcgggtgcctgctgtaccagccacgcagcttacggtactcggccttcatggacttcacgtcgatgatgttgtacgcctcgcactcgtcccatgcaccgggcaggttctgcatgcaggccacccacaggtcgaagccggggaagttcgcatggtcgtacttgcgcagctcgggaacgatgacgccggtggtgtactccagcttctgcgaggtgaacgcgaactcgtcgcggttcagcagcatcgggtcgatcacgctgaccggggagagcggcgggaagccgaggatggcgaggcgagccttcaccttgcgcaggtcgaacttcttgccgttgcgagcgagaacgaagtccgccgcgttgagcagggcgtggagaaccttggcctgcttgcggtcgttgaacacgtccttctcgcggcgctggtccacgtagatcgtggcatcatcgtcgtccagccactccgcagcgaacgacatgagggaccagtcgcgcttgatctgcttcgggctgaagttgttgttgaacatctgccatccccaaaactcgatggggaaggtctcgatgtcgaggcacagaatcttcggcccctgcttcggggcgtgcttcaggaatgtggtgaggttcacgggttctccttcttcattgctcgggccttacgcgctttcgcattgcgagcgatacgcttctcgtcctcggtcttgtgggtgggatgcagatagcccgtgatgttggtcatgtgctttcgcaggtagttcgcaagccctccgcagaaggcgaggatgtcccgcactccataacgtgggccattgttctcgaccttgcccagcagcgagttgcacccacgatggagtacgcctcgcactgcgccagtacgatgatcgtgatccagcaccgggtcgagcggtgccttcagtccgagctgaccgccgcacagtgcgcagcggttgccctgttctgctgcgagcttgacccgcaccagctttacctgagctgctgtcagtcgcttcattgcttcaatgcctccagcgcagcgcgcttctcgttgacatcctcggcgaggtcgtagaacgcctgcttcagcttgtcgccgaacacgtccagctggagcacgtccagcagcgtggcgtcccggtccgtccgcatccacagcagcaccgcctgctcggcgaagtaccgctgccacccgtcacccttcacctcggcgtacttaccgtacaccagcggcgcggcttcggcgttgctcttggtgccggacagcagcgcttccgccgtggccttgccaaccctcggcaggccggggatgaagtccgccgtgtcgcccatgagcatctgcatccagaaccacttgtgcccatactgcaagccgtccgcacccacgatgtcgtaggtgccgagcggcacgtccacgatgtggtagtcctcccacgtgatgtgggtgccgcagaacattcgcatgtccttgtcggcggtgtggatcacatgcagcacgttaccgtgcttggctgctccggtgctgacgaaggccatgccgtcgtccgcctcgcgggtcgtccagattttcggtgtgaagtgcgggccgtcgtacgtctccatccactcgcggaggaaggcccagttgttcggcttgcgtcctgactggcgctgcccctgatacggctgagtcgtagcagcgaggaacctgtcacccttcgatgacgcgccatgtgtgaggtgcatgacgacacgatccgctccgctgatatgcttcaggtgcgagacgcgggagagcacgttgcgtcgtgcatcccccgctgaacagttctcgctaccagcgcagaagtacgcagcgtagtccccgtccacgtgagcgatcacgttgcggttgtgctgtcgtacttccacgatgggcatcggggagcgctccgcagccgcagccatcagagcgctcaggtccatcaggcgacgcctgccatcgggtcgtccatgtcgaacggcggcttgtcgtcctcgtcgccctgcgcgttgtccacgtcaccgaccgccgcgtccagcgcatccacgccttccttggtgacggtgccgccgaccagcttggaggccgcgtagtcgtagcacggtagccccttgaagttcagcgccttggcgatttccagctggatggtgttcttgctgcgcgcctcggcgatgaccttgccggtcttctcgtccttgcgctccgggtactcgccttcgatgtagatgctgtcccacatttcggcgtcggcgaagtcccacacgaacgccttcagctc

SEQ ID NO: 24 - DNA, 43745 bp, Unknown
  Bacteriophage Xfas306
ttgacagtaagccgacagtgagctatgatgtaggcaagtgatcgagccaacggtaaggcggctggaccacctagcaagacaacgtaggcgctgccctagccggacacacgatagggcttgacaacgaaccaccggtgagctaacataggcaccacggtctgaggaccaccggcaatggaccgggcaggactaccgctaacgggtagggtgtaacgggaagcccttacgggtggaccgccaagctgcaacgtagcactagcggataaccggatgaactgggatgtaaaaggcccatagaatccaccagacttgcaacactggtgccgctttacctaagcctaacgcttagggcttcccatctgccgtgagagtcggccacgggaagtaacctactgccaaggtaggaagccggtcataagcgggtggtgagcctgctatcagcgggcatacccgttgtttcgtgaaaagtctctatgggacacacggtgacaatggcactgctagccggagtagggttgacagcccgaagggctagcagattgatgcgccctccctttgcgatgaccacgcaggcaaatccggtggttcagtgtgcgcccacgataggcgatgcaatggctctaatcgagaatgagggattgtccgactcgacggctttctgagggcgcatcaatctgttagttttcccaccagtgccaatggaggcacaacatgcatggctcgatccatgccaatctcgcccgcacccagcgtaagcggctcatctgccagttcacctggacggcaagcgtgatggacctgcgcaccacggagaatgaccgtaagcttgccgagcgcaagcgtcaagccgagtgctacgacgcccgccacggaatcgctggaatgcgatctgtgtttgctgtcgagggtaacagcgcgacgaaccggccgaaccacgccgctgacgggagggcttacctgtgatccggttcaagttctctcgccactacgtggaagctgcccgcgacagctacaatcgggccatcctgaagcatccggccggctctgtgtcggcgctctacatcctgccttgcggcgggcgctcgttcgacatccgactcgcttaatgcaagctactgggccttcgcaagagggcctagtgtcgtgcaatcggcacggacccaacctgaagggaaccaccatggacatgatcaccggaagcgctgacaccaagcgcgccatcaagtcgatcaagaccgcccgcaccaagctggtggaccagaatcaggccgctgagattgcggtcatcaaccatgcacacatcctcggcgacgttacgctcgcttccgatctgtgtctcgccgtgggcaacggcatgaagcatgaggccctgcgcctgtacctgtccgaattcggcccgatcgctcccaacgacgacaaggaaaccaaggcgagcgcgccgatgaagtttgccatgagcaagcgcgtcgagggcgaggaactggccgacatgctggaacgtgctgccgcgaaggcgtggttcgacttccagaccgaaaagcccgccgaggcgttctccttcgccgccgacctgcacaagctgctgggccgtctggaaatggccacggaacagggctatgagccgaccgccgaggaacaggccgtcatcaacgctgcccgcgccgtcccgaaggccgccaagaagcaggcgacggcgtaatgcggcccggtacccgcgtcatcggagccggacgtgctgatggatgaccagagcgcacgccacgtggcactgaccgcaacgcagaccggtctggtcaacaagcggcagaccaagggctggatcgtgcagttcaatctgcgccatggccgcatcgccctcgccaactgggcgcaggtgcgtgagctgcgtctgccgcagcgcagccgcaatgtagcgtaccgtgcactgaaggcgcgggccaagcgcagggcatcgccgaggacggctaccgtgtggtgcctgccggcactcccgatggcccggagaaggatcgcggcttctacaccgccgagatcttcaccaagcatgccctgcgtccgcatcagcttggctggaatacgtccggcgcacgtggtctcaccggcactttcccgactgcgcaggccgcagccaacgccatcgaccagcacgtcaaggacaccggcgcatcccgcagccgctatcgtgtgtacgtggcacaagaaccgcgcgtgatctaccgctgcgccttctaacgagggcgtagctttggaaccacgcccaacaggagggcaaattgcatgatccccgttacttacaagcgcatccgtcaggggaagcgcaagccgatccagctgtgcgagaacccgcgccagtggaaggagttcgtgacccatgagcacagcgtggagcgctggtatgcgtgaggtcagcctgtatcttgtggtgaaggcgctgccgctcgttaccgtgaagtatgtggctgttcccgattacatcctcggcggacagcgcaccagccacgaggcgtgcctccaggccatcgcgcaccaccgcctgcaccacgagaaggtgcccaccctctacaccatagaggaaatcgaaatcccacccgtcaacgaggagaaccaccatgcgtaagctgtacttcatcacgtccatcaaactcaccgcaaaggatggcgtcatcactggcgtggtcgccaacggtacgggccgcaagtccaccgccgaggaagtgaccacactggtcgagctgctgcgcttgaagggtgcgtcccctcccctgcccgatgcgctgtatgatgccacctatccgggtccgactcttgccttcgaccgctatgctgctgcccgtgccgaggcggcaaccctgaactcgttcggtggtctgttcgtctggtccgtcatcgagctgcctgagagcgtgcgtcagccggtgcgcaagccgctgggttggcggatcaagtacgacggcgggttcaccagctgctacaaccacccgaactacaccgcgaccgtgttcatcgacggcaactcgaagaacaccagcgaggacaacgtgctgtttgccacccgagacgccgcgctcacggccatcgagaaccacatcggtgacaagcgcagccgcaagaacccgcagggctactacatcgagccggtctatgcgtaagctctggctgcgcatctgtcgcccaatgtgctggatcacaggtcgtggtgtgtgggttgtcgtcggccagtctcatgacgacgacggtaagctgccgcggttccgctgtggcccggcttccaccgggttctcgctgacgttcgattctctcgacgcagccaacgactactgctctccgcgcaactggaagtctgacaccgacccgctcggcaccacgagatacgtgtggcacagaacggagttcaaccacttcggacacaggagaaagtgaccatgggattcctcgactctatcaagaagggcgcgctctacatcaaggacaaggtggtcaagtgtatcatgcccaagcgcgacgacgatgacaccaccccgctccctccggtggacacgagcaactacctgcacgtcagcctcccgctgatccccatcgacaacccgatcctgcgcaagtgtctggggcaggactacttccccgtgcagaaggggcagggtcagacctgtatcgtcggcaacaaccagctgaagcgcgtggccgatagcctcggtgcctctaacaaggaacgtcgcaagctgcgcacccggatgaagccgcgcgccgccgagctgcgtgccggttgttcgttgcagccgaacgtgcaggccgcactggcaggtgcagcatgagcctgcgcatgggatgttgggtctgtgtgaccgtgcccgacagccgactcctcaacgtgcagccggagtgtgccgccgccgtcaagctgatcggtggtgcgacgatgaccaattgtcgtggcctgtacgtccgcaaggatacctgtgcactggatgacgaggcggtgacctgtatccgcttcgacatgaacttgcagagcgagctggtggaccagtacatgagcgccatccgcgccatcgtggaccgcctgctggtgctcggcgaggagagtgtgctgcgtcgccgcttctacaatggcggcggtgggtacaacagcgagttgatcttccagtaatcccgcactgaactgtgccgactggcccacgttacgggccaccaaccaacccgtcaatgaaaggagatacactgcatgtcgaacgaatgtaacgccgccgccgaagccaccaccgtcagctgttacgaagccaagcgcgccgagctgctggaagacatcgccaaggcgcaggccaaggtcgatggcctgtgtgagaagtgtgccaagctggatgccgtcgaagccaacagcgccgccatcgaatgtctgtccgctggtgacgccgtgtcctacgtcttcggccgtgctctgaacaagcgtgtgctgtcgggcgtcgtggtcgccaccggcctcaacgacaagggcgtgctgcaactgaaggtgcagaccggcgaaggtctggatgccgagctgaacctgatcgacagcagcgccctgctgatgtcggccgaggaagtgctcaaggcgcaggaagaaatcgacaaggccatcgccgaagcgcagctggctgccgctgccaaggcgcagggcgaaggcggtcagtcgtgagccggggcagcaccagcccggcgtgtccgccgaccagcgcgccgagccgcagccagtgtaccgcaggccgtgacctgaaggtcggcttcaactaccgggccatcagctcctgtgcgggtgaagtgatcgacggcgacacctacctgctggtcaccaacgtgaccgacaagctcggcaatcgtcagctggtcaacaccagcaccggcgaggtgtccttcgccacgcccggctcctgttggagctactgatccgacgaggatagcatgagcgaaaccctccccgagaacgacctcctaccatgtgccgagcgccggcctgttggtggccgaacccgactcgcccaagagtgcggggagggtacgtttttgctaattactcgtgagcatgacaagtccaccgcaccctgttttaggtgcggtggcacaggattcaagcgtgagcacgagagtaacgaggccaagtgtgcgagaatccacgccgagcaaacgagcgagcgcagactgcgcgcaactgttgagttgccagagccacgggtatacgacacccgcgagtggccggtcgacgctaaggtgtggttcttcaagacgggactctcgcttcagatgatcgagaagctgcggctgtactggtgcccaagcatcgggcgggtggtactaccgatgactgaaggcgacaacgtggtatactggacagccccttcggcaacgagacagccgaagtggctaacacctgacgttccgaaagacggacttgacgcacgctacggcgtgggcacaggtgacaccatcgtactgtgcgaagacccgctcagtggatacaaggtgggactggtaaccgaagcgtggtcgttgctcggcacgaagctgcacaactcagtgttgaagcagctgactgatcgaggccaacgtgtagcgacgtggctcgatgacgacagaggtagaagcaacggtagcaatcgcggccaagacaccgcgcgagtaatcgctgcgcgtctacgtgcgtttggtctggtctacaggaacatcacgtcaccacgtgacccgaagcattacacaaccgactacatcaaggagaagctgcaatgagcaaacccatcgtgcgctaccggcgcgctatcatcccgcctgtcgttggcttccgtgccacgctcggcggcgtgcttgcgcatccgaacctcggcgactgcgacatcgtgcacacctcgacggtgctgtacgtgacagacggcgggcgcaagttcgagacacgcaacacccggtatcaccagctcgattcaaagtacgaacccgaaggagaacctgatgagtcttgacaccacgctgctgcggttgtgcaccaaccgtggcaagttcgaccggctggtacccagcgcaccacgtgatgggctggacgagctgaccgtgctgatgctcgatgcgttgcgtgcgtactacaaggagttcccggacacgaaggacttgccgttcgatgtgttcgatggctgggccatggagttcaagtggaagacgcagcccgacgacaagaagtccctgctgaaagttctgctgaagcagatgcgcgagccggtcccgcccgaggcagagcagggcatgatcgagaagctgttggagttggagcttgccaccactgcggtcagcaagatcgtgcagtggaatggtggcgctgagttcagcctgcgcgacgagcttgccgggttggctgagacgatcaccgaccgcatggatcgcaaggcccgcctgccgctggtgcaggagacgcccgaggaactgatgcagatggacgagcacgacatcggcatccacttccgactgcccacgttggcccgcaacctgcgcgccctgcgtggtggtgacttcggcatctacgccatgcgtcccgacgcaggcaagaccacgttcctgaccagcgagtccagccactggatcacgcagctcgacaacgtgtggccagaccagaagcgcaccggcatctggctcaacaacgaggggccgggcaagcgaatcaagcagcgctggtatcagtcgttgctcggcgcgaccatccctgaaatggtggagtgggcgaaggatggcagcatccgcaagcgcatcgaagatgcgatgggcggagacatccaccgcatgcagttctacgacatccacggattcaactccggtgaggtcgaggccatcatcaagcagaccaaccccggcttcatcatcttcgacatgatcgacaacatcacgttcaccggtggcatgaccaacggcgggcagcgtaccgatcagatgttggaggcgatgtatcaggccgcgcgcaactggtgtgtgaagtacgacgccgtgggcgtggcgacttcgcagatcagcgccgagggtgagggcatccagtacccgccgcagtccgcactgaaggacagcaagacgggcaagcagggtgcgtgcgacttcatcatcatgggcggcaagctcaacgacccggcgatggaacgcttacgctacatcggcaccccgaagaacaagctgcaccgcgcaggcggtaagcgtgacgttcgggaagaagtgatgatggatgcagagcgtgcccgcttctatcaggaggcagcatgagcaagcaggtacacatcgtggccgtcggccatagcgtctccgtgagcatccccggagactccacggaagcgcagaccttcaactgcgtgagcaacgcgcaggctatccacctcgccaagctgctgcgcaaggtgcacgacgagggctacatcgaaggccgcaacgacgcaccgcagtggaagtggggatggctgcggaacaagcacagcacttggatcggtgtgcactactcgccgcacaacaagcgctggtgcatcaacctgatcccatgcttcacattctggatcaccaagcccggaggtaacacaccgtgagtaccgaaccgaacatctatctgccgcgcaacgtgggcgtcatcacgtccagccgtaccggcagcagctacaccgtcgagccgcctgtgaccaacacggacatcgactacctcgtgctggtgcaggacttccaagaggccgtcgccaagctggtcgaggccgggtggaccctgtgctccggtgccgacgggcactacgaggaggacgaggactacagcgacacgtggtatgcgctgcgcaacggcgtgttcaacgtcatggtgactgccgacagtggctggtatcagcgcgcggtcgaggccaccaccatctgcaagcgccgcaacatcaaggacaaacaggaccgcatcagcgtgttccggtgggtgcgcgatgggctggacttggatggcgatgcgtcggatgaaatgtaccagcttgccctgcaacggtggccgctgtgagcttcacttgtttcgacctcgaaaccacgatcccctccatcctgaagcgcaaggccaatccgttctacgacatgaacaagtgtgtggcgattggctacaagcgcaagggtgacgcacggaacaccggcctgtactacgactgtcgcatcggcatcgacaaccagtacatgcccggcgcacctgacgggtggctgcgcgagctgtgttacgggcagcagttcctcgtcgggtgtaacatcaagttcgacatcctgcacgccatctgccaaggcccgctcaatcggcaggcatggatcgagcccatcgacggcggcggcatggtgtgggattgccagcttgccgagtacctgctgcacggcatgtgtcaagagttccacatggcgagcatggacgagacggctccccgttacggcggcaacctgaagtgtgatgcagtcaagtccctgtgggctgcgggagtggacacctgcgacatcgacaagacgctgctgatggattacctcctcggcaccaacgacaccgacgacgtgggcgaccccggcaacaccgagaagatgttcctcgggcagctcgccgccttccgtgcacgtcccggtctgcgctcggcgctgctcaacatgggcgcgctgtgcttcaccatcgaagccgagtacaacggcatgtacgtggacaaggaatgggcgcttgcgaaggcgaaggagttggaggtcgagcttgcaacagcgtgtgccgaactcaacggcttcatccccgagttgcccgagggcctgaccttcaactggaacagccgcttccacaagagcgcgctgatcttcggtggcaaggtgaagtacacggccaagcccccgatcatgtccaccgagggtgggccgacctacgtacagaaggacgaggtgcactatgtgctggtcgatggtacaacgacggcgacgccaccggccgaggacttcgaccccctgtggcggtacaccacctacggcagcggcaagaataagggcgagtacaagaccaagaaggtgcccgtcgatgacttgaccaagcagaagttccgcaacgaggacatgctgttcgagttccccggctacaccgagccggatgctgcgtgggaaagcaagagcgatccgggtgtgtactccaccgccgccgatgtgatcgaggcgctgggctatcgcaactgtccgttcaccaacgcactggcccgccgcgccgacatccacaaggacttgtccacgtactacatcacgacggacgagaagaccggcgagcagaagggcatgctcacgctgcccggaccggatggtatcatccaccacaagctcaacatgaccaacacggtgacgggtcgcctgtcatccagcgatcccaacttgcagaacgtgagcaagggtgagctggacgaggagacgttggaggagaagggttctcagatcaagcgcgccttcgtgtcccggcacaagggtggctgttgtatccagtcggactacacctccctcgaaatctacgtgcaggctatcctcaccgagtgccgtcagctgatccccgacctgaaggcgggcctcgacatgcactgcctccgtgccgagcaggcgtggggcgagcagggcaagtacgactacgacttcatcctgaaggcgagcaaggacgacaagcatcccgagcacaagaagtggaagaagccccgcggcaacgcgaaggtgttctccttccagcgtgcatacggtgcaggcgtggcgaagatcgctgcgtgtaccggcatgacggaggaggaagtcgaggcgctggtgcgcggcgaggccgagcggtacccggaactgggttgttacatcgaccgcatggtcgaggccatcaagcgcaaccgcgtcagcaccaaccgcttcgttccgcaccccgacgccggacggcagggcgtgcctgctgggctgacgtgtcagctgggccggtcgcactggacccccccggacggcaagatgtattccttcagcgagtcaccgtccccggtgttcatcgccaacaagcccgcgagcaagggcggctgcgcgtgttcgttctcgcccacggaaatcaagaactacccgatgcagggcaccggtggtgagtgggccaaggcggcgatgtacgtcagcctgcgcgccttctaccggaagtacgtgaccgaaccgaaggagtggttgggccgtgcgttgctcgtcaatcagcagcacgatgccgtctacgtggatgcacatggcgacatcgcaaccaaggccgctgctctgctgcacgcctcgatgctggaagcgtcggtgtatatggagtggtggttcgtgtggacgctgccgcttggcgtcccgtgcgaaaccaagatgggcgacaacatgatggaggagaagaatcctcccgcagagttcgccggtctggtcatcgagtaccgagcgtctatccgcaaggacttcgtaggtaatcacaacccgtcgtttgaataaggagaacaacacgcatgagtcttgacgcactgttgaacaaggtcgccacgcagggtaaggaccagtcggtcgccagtggtggcaacttcgactacaccccgcccgctgccggtgtgaccaccgcccgcatcgtcgggtactacgagctgggcaagcacgagttcgagttcgagggcaagaagaagacgcaggatgaagtcgccatcgtgttcgagctgaccggcaagcagcacccgcacatcgagacggacaatggtccggtcccggtgcgcatgacgctgacgctgggcctgtccaccaacgagaaggcgcactacttcaaaatcttcagccgcctgcgcaccgaggagcgccacttcgtgcagctgctgggtcagggtgtgctgctggaagtcatccacaagccgggcaagcgcgacccgaacaagaccttcgccgagatcgacaaggcttccatccgcaagccgatcatgccggtgccggaaatggagaacggcatcccgaccggcaagttcgtggacaccgtgatcccggtcccgcagcagatcaccccgctgggtgcgttcgtgtgggacttcgccgatgccgaaatgtgggacagcatcttcatccccggcgagtacccggagcgcaaggacgagaagaccggcaaggtcacccacgaggcgcagtcgaagaacaagacgcagctgcgcatcgctgcggcgctgaacttcaagggcctgccgtgctacgactacgccgctgccaagttggcgggcagcaccacggtcaccaaggaaggcgtcgatgcgctggacgaagtggtcggcgacgtggcgaacgctgcgcccaccgacgctgctccggccgacgacaagccgccgttcccggtggacggtagcgacccgatggcaggcatcgcctgatggacctgagcgctctcatggctgcggctgtggagcgctccccgatgccggtacaagtggtacgtcaacactgtccccgcgtgatcgctcacgtggatggggactacatggcgtacttcgcggctggtagcgagaactgctcggcgcccgatgcacggcgcaacgtgctctcccgctgcgcacagctgaagcatatcagcggatgtggtaagatcgtcatgcacctgacgcacggcgcatccaccaagggtgaccgcttcctcgctgctaccacgcagccgtatcagggtcagcgctgtgcaggccgcaagcccaacaactgggcgttccttcgtgagtggatggagacatacgagggcgacgctttcactcccaaaatctggctgacgcgagaagccgacgacggcatcgcatacgtcaacgagggtgcagcattgcaccacaacatcctgcacgtggtgcacagcgccgacaaggacatgcgaatgttctgctgtgtgcatgtagactgggaaggctacggcatcaccgaggttccgctcggcgcttacgacatcgtgggcgagaacgggttgcagtacggtcacaagtggttctggatgcagatgctccacggcgacaccgccgacaacatccccggtctgccgaaggtaggcaaggtgacagcggagcagctgcttctcgaccccaaggacaacctcgaagcggtgcagctggtgagcggcaagtacagcgaagtgctcggtgccgactggcgcaagacctttgccgaacaggccgtgttgctgtggatggtgacggatcgtgacgctgaactgctggacgtgctgaagctcgacgtgttcgggccgcagctgaagcaagcattctacgactgtgccgaggacgtgaaccccaagcgcgcaatcttggaggcatacaaagcatgaagcgactcactgcaacgcaggtcaagctgttgcgcatcaagctcgcagcggagcaagggaactgttgctgtctctgtcagggacagttcggcctgaaggctccgctcgatcctgtgctggaccacgaccacaagaccggcgctgtgcgcggggtgctcgtgcgcggatgcaactccctgctcggcaaggtcgagaacaacgcaggccggtatggcgtgcgcgatgtgttcgcattctgtgcgggcatccccaactacctggtgtcccacctcaccaacatcacggggtacctgcatcctacctacaagaccgacgacgagaagcgcatcgctcgcaatgcgaaggcgcgtaagcggcggtcactcaacaaggagacaccgtgacccttacccagttcattcgccgagcaccgaagcgcggcccgaagattctctgcctcgacatcgagacgttccccatcgagttctacggctgggggatgttcaacaacaacttcagcgtcaagcagatcaagcgtgactggtcgctgatgtcgttcgcttgcgagtggctggacgatgacgagtcgttctatatggaccagcgcaacgtgcgtgatgtcttcgatgaccgcaagcagggcaaggcactgtggcacctgctcaacgccgccgacttcgtgctagctcgcaacggcaagaagttcgacctgcgcaagatcaaggcgcgcctcgccatcctcggcctgccgcccgtgtcgcccgtgcaggtgatcgacccgatgctgctgaaccgcaccgagttcgccttcacctcgcagaagttggagtacaccaccggcgtgatcgtgccggagctgcgcaagtacgaccaccacaacttccccggcttcgacctgtgggtggcctgcatgcagaacctgcccggtgcgtgggacgagtgcgaagcgtacaaccgcatcgacgtgaagtccatgaagttggagtacaagaagctgcgcggttggtactcgcagcatccgaacgtcgccgtgtactacaaggccgatggcagcgagcaccgctgcaacaagtgcggctgcaacgaaatgatcccgcaggatgatccggcccgcacacaggtcggcacgtacctcctgcttcagtgcaccgtgtgcgacggctacagtcgtgggcgtaagctgacgaccagcgccgaggcccgcaagcacatcaccgttccggcataaggagccgacatgaagatcaccgacatccgcagcggcatgcgggtacagtacaccggaaatgcgcccggcctgatcgggcggcgcgggaaggtaagccgcgtgttcgctaaggatgtcgaggtcttcttcgacggacgtgtgagcgcgagctactgcgttcccgattccctccgacagcttatgagcatcggaggtgtgaccaccaccagacgagaggtacccatgcccgaactgaactaccgcaacgaggacgagcgcacgctgtccgaccgtggcgtcggcctgaaagatgacggcggcaagccgcaggctcggctgctgcatgagggcgtgcctcgtgcactggcccgcgtcatcgacaccttgaccttcggggcgcagaagtacaaggcgcactcgtggcagcatgtcgagaaggcgctcgaacgctatcaggatgcgagctaccggcacgacaacaagcgctgcctcggagagaagctggacccggagacgggcatccatcaccgcgcgcaccacatcatcaacgagctgttcctgttggagttggaactgcgcgaggaggagcaggcccgtggcgcagagtaagggtcgctcgatcaaggaggcgtgggtcaacatcgccatcgggtacagcatcaactactgcgcgaacatcgcgttgctgccgctgctgtggcatcccgaacacccgcttatgtcggcccacgccatcggcgtagccttcacgcttatcagcttcgtgcgccagtacatcatccgccgctggttcagcaagggtgactgatggcctgcgcccgctgcggccaagtgcaccggtacgtcccacatgaggccgagtgggcgcgcttcctagaggagcatcgtacccgcaagcagttcgatgtcgagtgggccaactcactctggcatcgcacataccctgacgacgccttctgcatccttgtgatgaagggccgcgcaggtttcgttccattcccgtcgaaggagaaatgaatgctctacaagaaccagaccgccatgcttatcaagtcctacgagaacaccgtggcgtggggcgagagtgccgaccacgaggaggcgttgcagaacgcggtcaaggcgggcttcccgaacctgccggaagaagatcaggccgagctgtatacccgcatcgccgatgcgtgggaaggctaccgtggttcgctcgctccgcgcaagctgtggatcggcaccatcgtcaaccagttcatgtcgtcccgcatcgcacggttcaacgccgcactgggcgatggcagcaagaaggaggacagcgccgatgtttgacatcaagcgagataacgtgcgggtcgctcccggctacaagaagcgcaagcgcggcttcaagatcaaccgcgccttcaccaagggcaacttccgggtgacgtggtacgacggcaaggccacctactgggagcagtacgtgccgtggtacaaggtgccgctcgccatgttccagatttggagggaccacgcatgagctacatcgtccactgtgcagtcgagcaggacaagatcaagaagaagctgcgtcccaccgaggagcagccccgcaccgagtacatcgcacagcccaagtacgacggctgcatgttggtcgccatcaagcgcggccactgggtgcccaccgtgaacaagggcctgcacgccatcaaggtctgtgacgtgcagatgcagcccgtggatcgcggcgtggtggacctgttctcccgcaccggcgagcaggtggtcagcgcgcaccacatcgagaacgctctcgcttccgcaccgttcttcccggtcggtgtctacttcggcccctactggcacccgaccatcgaccagcccaccgtcagcggcatgttccgcaagaaggacggcacgcagtacaccgagccgatgttcgtggtgttcgactacgtgacgctggaagaatgggagcagggatacacccacctcgtgtatcaggagcgcgtcagccgcctgccgagcatgggccacgccatcgccgagggtaccgctcccgtgttctacgccgagtcgcagggcttcctgatcgaccaagagctgggcagcatggaggcggcgaagctgctccccgagggtggagcatgtgatggcctgatcctgcgcaagccgagcggcaagtgggtgaagggcgacaagggcacgaacggccccgtcgtcaaggtaaagcccacaatcacgctggacctccgcgtcgaggacatcggcgtctgtgttggagagaagaccggccgcaacgtctacaccctgtgggtccgcctgccgaacggcaaggcgcaggaggtgggaagcggcgtgccgcaccatggcaacggtgttccgaaggtcggcgacatcgtggaaatcgagcccatgtcgtacagcaagttcggtctgctgcgcgagccgtgtttcaagggaatccgctacgacaagccggaggctgaccaatgagcaacgtcaagaccgaggtgtggcacaacatggaacgcgacacagtggaggtgcgagtgagcatcccgttccgcgagtacgccggttccttgtggccgaacgagacggcggtgatcgaatcgctggatcgcttcctcgccgagcggaggggctgatggacattcgattcggaaagcccgagctggatttcggcggtgatcgcttcgctccctacggtggaggtcatgtaaccgtgactgccactgcgtggtgcggcaccgagcagttcttcaaccgtcagtgcatcccgagctacgaggtcggcggcgacgcatggccgcacatcatcaacgaaatgcacaccgcactggtctgcatgatcctgaagcgttacccgccgacggacttcaccatcaagcaacggaggtagcatgctctcgtgtgtggaactcgaactggaaacctacgccttcggtcccgagcgcatggagaagtccatcgcccgcaacgaggagaagggcggcgcggacaacaacccctacgcccaagcagtgtatcgccggttcgtgctttgtcttgcggagcgcatccgtgcggacatcgactccccgcgcatcggccgcgcccaagcgcacgtgtgtcttctgcgcgccaagtacgatcccgagcgtcagaacaagcgtggacaggccatcagcgccgaggaacaggcccgcgagtggtacgaggctgtggccttcgtcgccgttcgcggtgcccttacctcttgcatgcgtgacaagcacggcgaacccagcgaccgcgacgtgctgaagaacgtcggcatcaacgtgtaccacgagtacctgctgacgcagttcgccgacgcagagccgacgctgttctgtcacctgatgaacgacatggaccgcaagctctctgtcaacgagaaccaccgcatgacggtgatgaagatgcagggtcgcaagaacggcatcgagttcgtggagtgggggcaggcgcagcgcgatcaggtcggcgcgtacctgtgcgaccagcttgcacagctgggcatgttggagattggcgtagtcaccgagactgcggcccccgccggtgcagcgtaccggaagttccagaccaagacgcacgtcaagatcgtgctgaccgacgaggtgcgcaagctgattacgcagatcagcgacttcgtgatcgaggccacgccgttctacctgccgtgcgttgagccgccgatggactgggtggacatcgacaacggtggattccacacgaaggaaatgcggcggtgtaatccgtggatggtgaagacctacgctcagacgcgcgacgagtaccgcgccgccgagctgcgctgtgagatggctgcgatcaacgcattgcagcgcgttccgtggcgcatcaacaagcgactgatggaacccgtgtcggccatcgccaaggtgcacgacatggaggaaatcatttcgcagggcgagctgccgaagccgtgtaagccggagtggttgaccaaggacatgtgtaaggaaaccatgtcccacaatcaggagttggagttcaagcagtggaagcgcgacatgtgtaactggcacaccgacgagcgcctgcgccagaacaagggcaatcgcttctacaacgcaatgaaggtggcgcgtaagttcgctgagtacccgagcatctacttcgtgtacttcgcacccttccgtggccgcaagtacgttcagaccaccggcgtgtcgccgcagggttcggacttgcagaaggcactcttggagttctccgaaggcaagcccttgctgacgcccgacgcgcaggattggttctgcatcacgggagcaaaccgatggggttacgacaaggcgtcgttgccagaccgagtgaagtgtgtgcgcgagcatcacgaccagatcatggccttcgctgcggacccggtgaacaacgacgagtggaagacggccgacaagccgttgcagtttctgagctggtgcatggagtacgagcagtggcaagtgttcggggatcgcttcctgagccgcatcgcagtcgggatggatggttcgtgcaatgggcttcagaacttctcggcgatgctgcgcgacgcagcaggcggggtggcgacggtgttgatcccggcaccgctgccgaatgacatctaccagatggtcgcagaccgcgtgactgcgatcctgctgggcgaggaggaagacgccgaagggtaccgcacgctgtggctcaaccatggcctgtgtcgctcgctggtgaagcgcagcgtgatgactctgccgtatggctcccggcagtcctcgtgggcggacttcatccccgaagactacctgaagtgcggcaagttccccacgctcgacaaggccctgtacggcccagcagcgcgcttcctgagcaagcgcatgggtgaggccatcgccgacaccgtggtcgccgcagcgggcgcgatgccctggttgcagcgcggttcgggtgcgatcctcaaccaagggtacgaccgcatccggtggatcacgccgtccggcttcccggtggtgcaggtgtactgggaatccgaggagcaccgcatcaacaccaagctgtgctgtcccgtgaagctgtccctgcgcaagagcacggacgcggtgaagaagtcccggcatcgcaacggcatcgccccgaacttcgtgcacagccccgtgtgtagccacctgacgctggtggtcaacgccgccaaggccgaggggatcgacgccttcgccatgatccatgacgacttcggcacccacgccgccgacagcgcggccctgtaccgcatcatccgggaggtgttcgtggcgatgtacgagcggcacgacgtgctctcggccttccactcagcctacccgttcctgccggagccgccgccgtgtgtgcccctggacctgcgccaagtccttgattctccgtacttcttcagctgacggagtttcagtacacctatagcacacaggccaaccgaggtccggttggagcggccgcgattgtaagcggaaccggtgccggaccttttggtacacctatagcacagaggagacaccatggccgaagacgccaaagtgaaagtcctgatgacgctccacccgaaccagcttgccgccgtgcggcgactgtccgggctgtcgctgtccgtcaactcgaataccacgcccttggaggcaggtatgcagttggggatggcccgcgtcctgaacatcttacaggagggtttcaccgttgatacctccgtaccgaacaccaacgacgggtgatagtgagcagatcaaggcggctttaacggccgctttgtatctgtcatctagagaagatagtaaggtagacaacagagagtcttctgtaagctacaactgtgatgatcctgattatacagtagctctgataactcagaacttagtagatgcagtcatcatagatgaagcctacctgctatgctttgccattgtcacaccgtggtattccaagaaccgtactacgttcgttgagaacatggtgctgcgcattgggccgggcagttccttcgaccggtacatagccgtgatggaacatctggctgacatcaaccactgtgactccctgagcgcaggcggtgcactagctcggaactcccgagcactcacacggatgtatgcacgctacggctacctgctggaacggcatgctccccaattcaccaagcgaaggagttaacctatgggtagcatcgttggtggtgggtctgcaaagaaggctgcgctgaagcaagcggcggctatcgacaagcagaccaacctccaaactcaatccacgaactaccagattcaggcgatggccgatcagatggcgcaggcagctgcacagcaggccgcatccgagtacgccgagaagttgctgagtgcccctgtcgataccgtcgatgtgcgactgggtacttctgacctcgacttgcagaccgccgacctgatcggccgacgcaagaccgcccgctccacctacacccggcccgtgaccacgaccgcagcttcccggctgacgaccgtggccgggtcagacctgttgtgaggtgagcatggaccatcccatccaaaccgcttgtcccgtgtgtgaggcttacgacaacaagcggcagggcatcatgtaccgatgtgaacgctattcgagctggaccgtccccaagctgttcgctcgcaagaaccgcgatcaggacaccgagccgctgacccacgggttccagtatctcggcgcacaggcagttaaccatctggcgaacaagctgatgatgtcgctgttcgcaccgtcccgaccgttcttccgattggagctgaagcgcaaggcgaagcaggctgcgcaggaacagggcgcggacttgcaggccatgcaggcaatgcttgcgaaggccgagcaggacgccagtctcgaactcgacaagcgctcgatccgctcccgactgtacgacctgctgaagatgctgatcgtgctgggcaacgccctcatggtgttggagaaggacacgtgtcgcgtgctcaacatgcggcactacgtggtcaagcgcactcgctgtcccgtgctgtacgaactgatcctccgggagaaggtgcacaagacccagctggaacccgccgcactcgctgccattgtcgcacacccggacttcaagcccgatgacgacggcatggtgtgggagtacaagtgggtcaagctggaccacaagaccggcaagtacaacgaagacgtgtggatttgcaactgcaagctgcccgcaaacttctcctcgacctactccgcagacaagctgccataccgagcggtaagttgggacttggccgcaggcgacgactacggctccggcttggtcgaggactacgaggcagacttccagtctctctcgatgctgtccgaggccgcagtgcagggcgcgatcctcgcatccgagttccggtggctggtcaaccccgcaggtcagacctccgtcgaggacttcatggcatcgcccaacggcgcggccatccccggcatgaagggcgacatcgagctgattaacgcaggcgtcgatggcgtgctgcaaaccaaccaagcaatccagtccacctacatcaaccgcatcggcgcaggcttcctgttgcagacggcggtgactcgtcaggcggaacgtgtgaccgcgcaggaaatccgcatggtcgccgaggaactggaaggcgggctgggtggcggctacagccgcatcgctgcggacgtgcaggtgcccgttgccttttgggtgatgaacctcacgggccgcgacatccgaggcaaggacttggagcctgtcatcatcaccggcttggccgcgctctcccgaacgggtgaccgtgaccggctgttggagttcggcagcaacctcgcaaacgtcctcgcgctgccgccgcagattctcgaacgactgaagctgtccgcgtggatcgccgacctcgccgccgctggtggcttggacccgaacgtatacgtgctgactgaggccgagtacggccagatgatgcagcagcgtgcgcagcagcagctggtcatgcagaacgcatcgcagcagatcgacaacgccaacaacatggagacacagacacaatgagttccaacgcacctccgggcggtggtcccggcgcaaccgtgatcgcaacctcgcacggcaaccagcccgccccggcagctccggctccggctgacgacaagctgctgcccaacggacagcccgcaccggctgcaccggcacagcccgcagctcctgctgcgcctccggctgctgacgctctgagtctcgaacccgctgctcccgcacagcccgccgccccggcgaacgctgcgccgactgctgtgtcgattcccgactacggcgacaacggcctgaacatcgcggccgaatacttcgtcaacaccgtcggcctcgacatcgacagccgcgaactgaccgaagcagcgaagggcaacttcgccctgctggaagccaagctggaagtcctcggcgataaggccaagggttccgcaccgatcctcgctctggcgaaggagagcatcgctcgtgtcaccgccgctgcaaccgcagcgcatgccgcgaacgttgctgctgtccacgaagccgtgggtggcgcagagaactgggctgcgatccagcagttcgcacgggccaacctgcccgccgaccaactaaagcaggcaagcgaatcgctgtcggctggtggcttcggcgctcaggcgaccgcgcgttacctgatggctctggcacaggccaatcccgcgacgaccgtcaagggcgcaccggctaccaatgccgccgctcctgccgcgtcgatcaacggcgtcgctcctctcacgaaggagcagtaccgcgctgagtaccgcaagctggttgccgagaagggcatccgtggtgcggcccactccgaagaactgcgtgcactcaacgcgcgcgtcatccactaagaaccaaggagcaacataaagcatgagcaccatcttctgtaccgtcccgccctgtccgaatcaggtcaaccagtccggctgtgagaacgcgctgatcctcgaacagttcaccggcgatgtcgagcacacctacccctccagctcggtgctggaaaagttcttcccgcgcaagcaggtcaagggcacctgtaccctgaccaagaaggccatcggccgcaccaagcttcagaagctgaagcgcggtgatgcgccggaccccaccccggtggacttcagcaaggcgtcggtgaccgtcgataccatgctgctgtcgcgtcacagcatctggcagctggacgaaatcttcaccgacatcgacacccgcaagtgtatcgccatcgagcagggtcaggaaatcgccgagttcgtggacctgaccatcagcatcgccgcctgtcccgtggctgctgccacgcagtcgatcttcacccgcaacggccgcgcgccggaaggccacttcggtgccacgcaggtggtcctgtccgctgccggtgacgagaacgatccggccaaggtctacgccgccatcggcaagctgttctcccgcatggaggaggagaagaaggtcaagccgcagcgccccggcgtggtcctgatcgtgcgtccggcgatcttctacctgttgcagcaggccgagcagatcagcaacggcgagtacctgacctcggacggcaacaagctgaccggctgtccgaccttccacggctggggcgtcccggtgctgtcgagcgagaacctgccgtgtaccgtgatcgaaggtcacctgctgtcgaacgacgacaacgacgacttctacgacggcgacttcagcaccctgatcgccgtggccgtgtcgccgaaggccctgctgatcgccgaagcgctgccgttgcagtcctcggtgtggtggagcgacgcctcgaagtgctacttcgtggactcgtggatgtccttcgccgttggtctggatcgcgtcgagaacgcgggccgcatcgacaaggttgcctaatccgctgggcgcggtccctgaatccttcgggtaactcaaaccgcgcccgccttccaccaacacaggagcaccatcatggtctttgaccgaccgttcgagatttccaaccgcgtcgtcgccgctaccggcgtggccggtctgcccgacaactccgtgggcaccgtcgtcggcgtccactacgacgccatcggcgcgggctgggtcgtgcgcgtccgtttcgttgacgacgaaatcggctcgcaggacgtggagtacgcaccggcctcgctggctctggctgcggactaagcaacatcccggcaggggcgctacggcgtctctgccttgttcctctcaggagacaccatggcattcatcaccaagctcgacatcgtgaacgcctgcatcaagacgatgggcgagacgaagctcaacactctggaagatgaccacgtatacaaggacgacgcagttgacttgatcgaccgcgtgcaccgcgacgtgtcgtcgctctcgctgtggttcaacaccgaatgggtggagctgaaaccgcaggcaacgagcaagtacatcatggtcccaacggacgtgctgaagctggactgcaacccgagccgattcggccacgtggtgcagcgcggacgccgcctgtacgaccgcaagcgcaacacctacgagttcgaccacaacgtgcaggccaagctggttcggctgctggacttcgatgacctcccctacgaggtgcagatgttcgtgcgggacgacagcgtgctgcgtttccagtccgacttcgacggcgacaacaccaagtacgccaagatcaagcagcagcgcgacgactcgtggatcaacatgaaggccgagcatatccggcagatcaaggcgaacccactgttcgcgcgtgcgtccgtggacgtgctgcatcagcggtacttcaactacagcggacacccgtggcatagccactacactttccccggctaaggaggcaacatggcaaaggcaggcggatgttatcccgactgtgtgcagggtgtcagtcagaaaccggcgcacaaatgtggccgggccagacgcacgagcagatcaacgtgctgtccgatccggcccacggccttgtgcgccgtcgtggtacgcggttcgctgcttcccaagccgttgtcacctcggccgagctgcgcaacatggacgtgttcgacttcatgcaggaaggcaaggagtacgcgctgctgtatcggcgcgatccctctacctgtggaagcgagacgttcgcgttcctttacaacaagacggacgaggcgttcatcccgctggtctacgagaacagcacgtgggtcaacacgctggtcagcggcggcgcgtcgtcgctcgcggccatcggcagctacgtctacatcgcgggcaacaccacgatcccttcggccaccagcacgaacgtgtggcaggagcagacgaacatccagcgcctcgccgcgtgggttcgcactggcaagtacaacacaacgtacacggtgtaccccccgcgcacggacaacacggtgcaaacggttacgttcaagacgggtgccgcatcgtaccccggcacgctcgacacgagcgacatcccgttctacctgcccggtggcacggagccggacccggcgtatcagaagtacgtcaacgaccgagaaaacgagtacaactccgcagtcaacgagtggatcggtgccagtgccgagcagacgcgcccggagtacatcgccgagcagctgtcggatttgctggtggacgcgggcgtggcggctacccacatcaagggcggcatcatcattgacgacgaccagttcaaggacatcacggttgacgacgagggcgacggcacgaccttctacgccgcagggcaggagattaccgacgcgacctacgctgtcaagttccactggcacggcaagatcatccgcgtgcgcccgagcggtgcaggcgcggacgagacgtactacctgcgtgccgagttggagaacggcgagacttcgggctacggctcggtggactggtacgaagcgcccggcgtggagtgcaccatcgacaacctcgtgtcgcagctctacatctacaacggtgtgggctacatcgcacgcaacggcgcgggcctcacgtctctggctccgggcagcggcgagcacccggcttacggtgcgcgggttgcaggcgacggactgtcctctccgatcccgtggttcatcgacaagccgatcaccatgctgtccgtcttccaagaccggctggtggtgggcgcgcagaactacgtcaacgcctcgcggtcggcggactaccgtgacttctggcgcggctctgccgtcaccatcgaagacagcgaccccatcgaaatcttcgcgcatggcagcgagggcgatgtgctccggcacgccacgctctacaacggcaacctcgttttcttcggtgaccgtcagcagtacgggatcagcggcgactcggtgttcagtccgaagaacccgcttatcaaggcgttcagtgcgaacaaggattcggtggacgcgaaggcgcagacctcgggcaactacatcttctatgcgcagtacggcagcgaaggcacgagcctgcaccagatgcgcgtcggtgcgctcaacggtcagcagacggccccggacgaaatgtccaacgagctggactcgtggctgtccggcacgccgttgcagatcaccgcgctcactgccccgaaccttgtgttgttccgcacccgagagcacccgcaggacttctacctgtaccggtacgaggacaacaagaacaatgggcagcgtatcgtggactcgtggtcgaagttccagtaccacccggcgctgggcgaaatcatcggcgtcagcagctacaagaagaacggcctcgtattcaccgcacgcgggtcgctggtggcgtgcgacgtgttcgacccgaagggcgagccggactcgcatgcgtgcctcgacagctgggcgagttttggtacacctacgggcgtacaaaccgcgagcgcaagcatcgccgtcaatagcactagcccgtacttcctgctgggttgtccctacgctcaggcgtcggacttccttagccagttcgatgacctcgatgctggtgcgctggaatacggcgtcgtgtctgaggcgctgggtgtcccgaccaatccgttccctcgggaccagaacggtcaggctgtgctcgatggccgcatgtcgcgtgacaaggccccggtggacgtggagaacacggcgggcatgctcgctgcggttaccacccgcaacaacagcgtttccaccacggacttcgagggccgcatcctcggcgactccgacaacctgttcgcgcggcaaccggtgtaccgggggcagcgtgacatcagcgtcgggcgcgaagtgcgtgagtgcacctacgagattcgcagcaaggattggctcccgctccgggcccccggcctgtgctggacgggtcagactttcaacaatgtacggagggttcagctgatgggttcggttcatacgatcctgcaagcgaacaacaccacccgcgttgcccgtgcgaactaccgtgcagccgttgcgcagaccgacaacacgaaccgcagcgaggtcgccaagaccggcttcgctgatttcatgcggtccctgaagaacaacgcccagctggacgccgccgcgaaggagtacaactccaacatggaggcgctgtccgaggagctgcgtgcacgccaaggggctgggcttaactcccagctccaactggcgaacgcgcgcggtgcgcttcaggcacaggccggtgctgtaggtgtgggcggctcgtccgcagacctgatggataccatggttcgcttgcaggcggaaatggacaaggagacgcaggacaacgcagtctcgctgctcgcctctcgcggcgcatcgcagacggcgcaggtcatgtcgcgcgcgtggaatgggatggacatgagccgcacgttcggccagttcgactactcgcagcacatcgagccgaaggcgatgaagcgtcgcttgggcaagctgatcggcgtggccgtggctacctacttcggcgggccgatggcaggcgaggctgtggcagacttcgcagtcggcacgtggcaggcggacaacggcaacttccaaggcatgtcgcagtccttcaacaacgcagcgcagaacgggatgcaggcgtggcagcagtccaatgatcgcggcggcaagtcgtgggcgtccactaccttcgggtacaacgacggcaccggcaagcagtccgtgaccggggcgaaggtcaccggcaacttcggcaacaactacgacaacttctccaccactacgtccggcctcggctggttcgacagtggcagcggaggcaactcaggaggcgcatggtgatggctgacatcggcacggttaccttcaacacgcagtccgcattgcagggtggcatcaacgccacccccgcactgtcgggcaacaccagcattcaaggcgctggtgtgaatcaggtcggccccgttcgctcgggatcggattggttcgagagcactggtggtatgacgatgccggacagcaacctgcccgagttcttgcaggaactggcagcgccgaacaccgccaagctgaagcagcagcagatgtgggacggcttcgttgccgcccgcgctggtaagaccatggacgagattgctgcgaccgagccgtggtacaagaaaatcttcggcgacaccaactacgagattggcgcgagcatgtataacacgctctcgcaggtcaacgaaatggagagcgacctgctgcggcgtatgccggagttgcgtaagcttccgcccgaggcgatggcgaaggagttcaacgacctcgccactgcccggatgaccggcaacggtttcgcggacacggtgttgcagaagaccttcatggatcgcgcgggttcgctgatggacctgcacacgaaggagcgcacggcgtggcagcagcaggagctggtgaaggcgcagtacgctgcgaactcgtcggcgtccactggcttcaacgaactggcgaagcgcacggcgatgctcggtaccaaccgtcccatggacgagaaggccaccgaggcgctgacacaggcgcagctgtcgttgctcgacggtctgtcgccctcgcgttaccagacggacgagtcgtacaagtcggcgatcaccgcgttctaccgtggcgctgcggatcgcggcgagttccacacgctgaagttcctcaacagcaagggcgtgctgaacgccatcgaccccgacgggcagctgggaatccagcagtacgtgaagcaggcgcaggatcggtaccgctcggactggctcgatgccaacccggagcaggccgagaagatggcgcttgtctccatgtacgcatccgagggcattggtgccaagccgtcgcaggcgatgatcgaggaaatgaacgcgacctacgccgctgagacgggcagcgatgcgccgctctactcgggcacgcagcttgcttcgatcatggcgcagtccgcaggcgcgcacatccgcgcgcaggaagccgtcatcaaccagcgcaacgctgcggctaaggctgcactgactgaccagcagaagctggcggcgcaggaggaggacatccgtggcggcatcgagtcgttcaagcgcggcacctacgcgcagacgatcaacatccccggcgtggacaaggagctgatcgaagcgaacgtggtgcaggcgtggaactccacgatggccgcgaacccgaaggtcgccatgtcgcagctggtgtggaacgccaacacagggcgcggcgctgtgctgaagggtgtggccgatcagttccagaccacggcgcgcgctgtgctccgcgatcagccgaacacggcagcggctgcgctgtaccagcagtggaaggaactgaagcagacgaccgctgcgcgcatcgacacgaacggtcagcctgtgcagggccgactgactggcgcaactaccgccgcgctgtacttcggagatagcgtcaacacgttcttcaacaagctgcaagcgttggagaatggcggcgtgaacttcgagcttgcctacgaggtggcccgtggagaaatcaccaccgacgatcccacgcagttcgacgcgaacagtcgtaaggaatccgaggctactcaggctcgtgttaacgacgctatcgcaaagctcaaccccaagtacctcgggatgttcggcaacaagctgggcgactctggccgcgctgcgtatgctcgcgccatcgtccggtcggtcaccgacagcggtgggctgctggacacttctgcggaaggtttgcaagctgcggctacccacgctaagctggcctacggtctggaagacgcgggcaagtacgcatgggagaacggacgcgacgacgaaggccgagtgatcggcggtgttggtgcgtggctggggttcatggacacgaaggagacgggaccggccatcgagaaggccatcgacgcagcactgcggcgggtcaacatcgagcctactaccagtctgaaggctgacgtgttccgcatgaaggacagcgagaacggcgagccggtgctgtacgtcaacgctgttggcgagaagggctggaaggttgtgccggtgtacgggcgcgacatcaaggccgagtacgagaagcacacgaagcagcagcggcagttgcaggccccggtaccgcagggctacgttcgcatgaacgacggtacgattcagcagagcatttccatccaacccaaactgtaaggagatagacaatggcactcgatctttcggggctgtgtcaagaccagcagattgccaaggctgccgcttatgcgggacccccggagtccatcgtgaaaggtcagtggcgagtagagtctggcaacggacgcgcagccaagaaatgtcccggtgtgatccgcagcaaggcaggagcgcagggcgacttctgtaaagtgcccaccacgcaggcaacgaaagaagcgcgcaacggtcgcaagtacgacatgcgcaacttccaagacagctgtgagctgtacgccgacatcatgcgcgagaacatgcagcttgccaagggcgacgttaccaaggcgctgcgtatctaccaaggcggcaccaacccgaagaactggggacaggagaacgcagcctatgcaccgagcgtgctgggtggcgcatccgctcccgccgtgtcggcgcagccgcgcagcctgaccaccactcaggcagacctcaacgccgcgtggcagggcaacccgaacatgcgcgaccgcacgtggtccggcgcttccatcccggatgcgtggaccggtgctcccatcgaaggccgcaacgctctggcgtcggcagcgaaggaacacatcggcaagattcgtgcgggcatcgccgagctgtcgatgggtcaggtggcgcaggaaggtggcaccgcagagcaggctgtgggcaaggcgcaggccgtccgtgcgtcggatcaggtcgtgccgtggtgggtgcgtcaggaagtggacgtgctgaataccggcgctcgcaaggcgctgctggatcagaccgagcaggctctcgcacaggagcgtgcagacgaggagctgcgcaactcgctgaccttcctcgacaagtggggcgcggcattcgacagcggcatcggtgcggctatcagcaaccagcttgcgcgcgaggacgagaacatcccggaaggttggaagtacgacccgaaggaatgggagaagtcgtggatgaccgccgacgaactggaagacatccgtgacgctgcgtactcgccgaacgagctgaagtacgtgagcgaccgccagtggatgcgccgcaactccatgcgcatcaaggatcagcagaccggctggtcgagcttcggctacgacctcgtggcaggcttcaccgatccgggcaactgggctatcggcggcgtcaccgctgcgggcgctaaggtgctgggcgtgggttcggctgcgctggtggccgaggggcgtgtgggtgcttcgctcgcatctgccgctgcggagaacgcggtaggctccgtcatcacggacgccgctctggtgggcatgggcgagcgccgcaacttcgcggactttatgaccgacgctgcgttcgctaccaccatcggtaccgcgatgcacattccgggcgttcgctcggctgcgcagattcgggacaaggctaccatcgacctgtccgcaggcaacgctgccgcttacggcgaagcgtggtcggctgacctgaaggcgcgcgcggtggccgagcttggtgacaacgccaacccggtgctggtcaacaaccgcatccaccagcttgccaagcaggaagcagtcgattggctgcgcgctggtatggctgatgtgccggacgacttccgcatcttcgcgcgtcccgacgtgcaggagacgaccaccaccgcaggcaccactggtgcactggctcgtgacgtggacaacgtggacgcctcgaccggccggtacaacgacagcgtgggtggtcgggtagatcagcatgatccgctgctggaacgtgcgtggaaggccgcaggcatccgtggcggcaacgtggacggcgtgctgaagtatctggaatccaacgcctcgatcccagaggacgtgcgtgctatcgccaatgcgctgaagcgcggcggtcgcctgagcacggtgaagatcgtgccggagtcggaactcgacaagtggttcgccggtgccaacatgggtccgggtatgcgagtggccggtggctacaacgccgggctggacgcgatggcgatgcggaactacacgccggaagtggtggtgcacgaaatgctgcatgctgccaccctgcgtgagctgcgcagcaactcggtgttcggtcaggaaatggaagaactgctgacccacatcaacaacagcatcggcagtgtagactccacgctcaccaccgctgcaatggagacgcgcatcaaccagccgcagtcaggcttcctcgccaacaccgacgagctgatttcctacggcctgacgaaccgcgccgtgcaggcggtgctgcgtcagatgcctgcgccgggcaacacccgcccgaatgcgtgggagtggctgaaggacaagatcgcgcgagtgatgggcctgaagaatcaggagtccgctctcgaacgtctgatgtctgtggtcggcgacaacctcggtgctgaagtgcgcgacacgcaggcatcgacccgacagactcgtggcatgctcgccaactcgatcttcaagtcgaaccgcgagcgcaaggcgttctatcagcgcactggtctggacaagtccgtcagcgacgacgcgatgcgcgtgcaggttgccgaggtgatggcgcgctctgagcgcttcagtgccaagtatggcatcgacgcggcgaagctgtccaccatcatgcagcgcttcgggctggaagctacgagcacgaccctgatgtcgtccaagtcgccggtcgctcgtatgcttgctgtcaccctgttggagaacccggagggtgcggcaggccgacacagcacggcggcgatggatcggcatggccggttcgagtcgttcatgggtacgcgcccgcgtcagtgggaagcggcctaccgtctgtggcgcgcggacgttcgcggcatcggtgcgatcaaggacttcgccacgggctggaaggcacgtgcggacttcgagtacgcagtgaagctgtaccgcgagactcgcttcaacggtggggacatcccggatgcgcacgaggcagtgaaggcaatggcccgtgagctggaccgtggctacaaccgcatggcagcagagcagcgcgcggctggtacggtgggcgcacagcgtctgccggaggaagacgtggagggctacgagtcccgcacttggctgggtggcagcatcgctgctgctggtccggttcgccgtgagggtatccgtcaggcaatgcgcgatcagttcgaggtgatgggcgagctgtatggggacgacttcctcgacaagttcgctaccaagtatctggaacgcatcgagcgcaaggcggcgggtatcatcgaagcgccgggtcaggtcttctcggagtcgcaggcggacacgctgcgcgatactctgcgggcgatgtcgctcaacgaggaggagattcagaaggtgatgggcaagtacagccgtggcggtgcgaagcacaccaaggcgcgtatcgacctcgacgtgaccaagcagtacgaagatgctgatggcaagttccgcctgatggactacctcgacaatcgcgtgatggacaactaccgcaagtacgcgggccgtgttgctggtgacatcgctctggcgaagcacggcatcctcggtgatgcaggcatcaacgtggctcgcgaagcaatgcgcctgaccggtgcgactgacgtggagctgaaggcgttcgagcaggtgatgtccgagttccttggtcgcccggtgggcactggtgatccgactgttctggcgaatgcgcggctgctgacctcggctatccagctgggcggcgcgggcatcaatcaggcagcggagtacagcaacggcctcgccgctgttggtgctgctggtgtggctgacgcaatccgtatcgctcctcgcatgcgcagcgaaatcatgcgcatcctgaagggcgaggacagcggcaaccaaatcctcgacggcttcgagttcatcagcggtcgcggcttcggcctcgccggttacgatctgcacatgttcaactcgctggacacgcaggcgtcgatgtacggcagcgagcgcgcaggcttcctgacctcgctggtgcagaaggcagcgcatgcaaaccgcatcctctcggggcagcgggctgtgctcgccgtacagcagcgcggcttcgcggaagtgctgatcgccaagggcgtgaagttcctgcgtgatggtgccgaggccgacaccgccctgaaggacatgggcattgacgacaacctgctgaaccgcctgcgggcgacgcaggatcgggtcgtgcgctggggcgctgacggtaagctggaagcggtggacccgcgcaacgtcgaaggactggcggatcggcaggcatggttggcgttctacaacgcgatcaaccgtggcacctcgcagattcttcaggacaccttcatcggcgagactggcaagtgggcgcacaacggctggctgaagctgctgttccagcaccgcacgttctcgctggtcgcacagcagaagcagctgggccgctacgtgggcaactacggtgcgtggcagactgcgggcctgatcgctgcggcgatggccgtggctgcgccgctgcaagccctgcgcgtgctgtcccgcgtggccctgatgaacgatcaggagcgcgacgaagccatcgaccagaacatcctgtcgcctctggcgctgggcaaggccacgctgaactacgtgtcggcgacgggcatgctcaacgatgtgctggacgtgggcaccggtgtggctggtggctggtacgagtacgccaccgatacgcagggtccgacgtggctgaagcagctggccggtgggcagttcggcaaccgcaaggaagtggtgggcgggcagttcgcgcccgcgctgggcgtcgtcaatgacttcgctcaaggcatcgctggcaagccggagaatctggccgacgtgattccgggcgggcgactgcccatggtgatcccgctgttgaagggcgcggccagccagtggaaggaggagtgagaatcagggccaaggacggcccacccttttggtacacctatagcaaacaggaggcagcatggcagttccagacccgcagctgcgctacgcgacagacgtgttcgacgccgatggcgtgaccactgactggcagatcagctttaccggtggctacatcaacccgtcccacgtgtacgcaatgagcggactgttggacgaggagactcagctgctgaccgaccggactccgcacaccgtggaagtcctgagcgaagacgatgacgctagcaccgtccgtgtctcgcctgccgtcgccgctgggcgcaagctctacatctaccgcagcactccggtgcagcagatgctcgttgactacgttaacggtagcatcatcagcaagaccaaccttaacctcagcaacgaccagctcctgaagatcattcaggaaatgttcgactcgctcaacatcgccacccttagcatcgaccaacaggtcggcgtgatcgtggacctgaacgagattatccagaacatctataagcaggtcaccgagttgctggccgctggtggtatcgtgtccgtcgccccgcgcgtctggtccggtgcatggaccggcgatcaggtggacgacaccgacttcgacatggtgggcgcggacgtgtccggcgctggcttctacgacgtgtacgtcaacggaatcggcatgcagccggacgtggactatcaggtcactctggccgacgacaccgatcccagcttcatccgcttcgccacggttcccgccgagggcagcatctggttcgccgtgctgcgtggttacgccaagccctacaccgggcctgcgccgatcactgctacgagcctgcgggtgccgatcatcccggcagaaggtccgacctactacgccgacaaggctaccgagtacggcctcgtgcggtgcacgtatgccggaggctgtgccgtcaacatcaacctgatccccgaagtgggcgacggtgagacgaagcttgcctcgggcagttacttcagcgttcagcagaaggcaggcccggtggtcatcactggcgacgtgggcgtgaccctcgaagtcccggtcggctgcaccgccgcaactcgcggcaccaactccgtcgtcactgcaacgtgcatcgacggcgacaccaacacgtggttgctctcgggcgacttggctaaggagtaagcatggctaatcacttcaggctgtacggccgaccgctgatggcggacgaggttgcagatggcctgtcggtgacgggcgtgctggaagggtacacggcgggcgaggcttacgagtctcgcctgtccatcaacaacccagtcggccgctgcaccgtggaggtcatcgaatcgacgctcccttcgggcgctgcggtacgggtggacaacatcaccaaggaagtcgtcgtcaagtgggcggctttcactgaagtcgtggacgaggaaaccctcgtacccaacggcgacttcgaggcaggcgacgatggcacgtgggttccgggcggtggatcgaacggcgaaggctggtcgattggcactggctcggactacgataccgacagcggcgtatacagcgcgcgcttcgccaacatcaagacgggcggtagcgacttgctcaacccgctgatccctgccaaggtcaacgactacatccgctgcaccgctgaagttcagcagggcgcaagctccaagggcaaggccggtgcgcgcgtctcgatcatctaccgcaaggaggatggcaccgagctgcaacgcaactggggcaacatggtttcctctggcagcaacggtgcatggcaccagtctgtcgccgagggcgcagcgcccaaggacacgaagtacgtgcaggtggtcctgtccgcattccgcagcaagcagaacaagccgctgtgggtggacaccgttaagtggaaccacaagtatgtgctcggtcagaacgacgacagctcctacttcctgagcatcaaggtcacggacgggttgaaccgtgtggcctactggtccgggcgtatcgaggagcaaggcatctacgtcacgtcgaagctctacagcttctaccagttcgatgcagctatgctgaccagcagcttcgctggatacagcaacatcgacatgcttccgcctgttgactctgcgacgttcggttcctccttcgtgagttgggaaatccgtagctcgcgtcaggattacaccgccgatccagagacctcactgtacggaagctcgttcgtgtcgttcgacatccgctctatccgaaaggactactcgcctgacccggagacggcaaggctgtccagttctttccattccttcaccctgaagcagcaccctgttgtgaaccagccgcttgatgcgtctgcccagctgcggtctggcttcgtatcatggagcttcgcatgatccacaatcgactcggcgtagccggtgtgttcactatcagcaagggcaagtccctcgattcgctggaagttgtggcagactggcagaacaacctcatcactgacggcggcatggacgctatgggtgacaacggaaatggctacgcgcgcagcatgtacgacgttatcgcgtacttggcagtcgggagcggtagcgcgacacccgcgttcactgacaccgctctcggtgctcaggtggcgcaggtcgggcgcaccacgtcggacaacggcgggactactactgccccgtactacgcctactcgcgctgccagtaccagttcccggcaggcactgctaccggcgtcctttccgagctgggtgccaaggcgtacaacagcagcaacggcacctacatcctgaccacccgcgcactcatcaaggactccgcaggtaacccgaccaccatcacggtgctgtcggatgaaatcctcgtggttacttacgagctgcgtctctacatcgacacgactccggtggtgacgactgagacgatcaagggcgtcagcaccactgtgacttgcaagcccatcgccctcggccggagtggttcgctcagtgggcagtctgccatcgcgtggtcggactacgtgtggggctgctactatttctatggcggaaccggagacggtaccggcgcgatcactgaccagtatcctccgggaaccaacatcagctactcggacttgcagattcagtatgtggcctacgttgctggtagtcactatcgagacgtggtgtgtcgcatgtcgatcaacaacgttcccggtggtccgatcacggctgctatgggcctttctgcttgcgcctcgttccaagttggcttcagtccgggcatcaccaagaccggctcggagacggcgaacctgcgcatgcgcgtttcgtggagccggtacacgccatgatccccactgtctcccaaagcatccaacggggtgactgggtggagcagcagaatcggcgcacccgcccgctcatcgacttcgagcagggcgggctggccctcaacgcatccgtggacgaccttcaggctgcgttgtggaccgccgagagtgatggtagcagcgtcgtcgtttaccgcgacggcgttgctcctgtcaccgtgctgacggactcgggtatcacgcagatcgcactggcattcgaccagaccatgcgcccgcacatcgcgtacatggcaggcggcgtgtgcaagttctactggtacgatacggtggctgcttcgatgcagaccatggtgatccccggtgctaccactccacgactgtgcatggacgagaagcgagcaatcttcgccactcagagcgacgtgctgctgtcctacaagaatgggagtagcctgtgcgttcgagcacagcgcgagcgcttcgcaaccgaacacgtgattgccaccggaatccccggtgacctgatcgcggttggcatgaacaacgtcaaccgcctgcaatggaagctcgtcggcaatcccgacgactggccctaacctacaggagaacagcatgaccccgccgagtgtggtcaatgaggtcgtccgaacctcgccgcttacgctcggcgcggtctacctcaacttcatcagcacttacggtgctgccatcgtaactacgctcgccattctgtacgcagtcgcccagttctactggcgcgcgcgcgagcaccgcaagatcatgggagggaaggatgtcgaaccccgcaagtgagggcgcgcttggcgcactccacgaacttgtcgccacggtcctgaaggaacgcctcgccaacggcgagctgtgcaccgcagccgacatcaatgccgcgatcaagtttctgaaggacaacaacatcacggctacgcgcgaggccaacaaggccctcggcgaactggaagacgaactcggcaagcactcgctgccgcaggccgacgacaccgagctgcaagcagcgctcgacaacatcgtgaactttccggggagcgtagccaatgcgtgaatcagcttttgcggcggacattcgtcgcaagtgtttggaactgttgcagaaccactatcggcacttcgccgtgttcatgcgagacatcatgaaggtgctggggttcgagccgacgtggatgcagtacgacatcgccaactacatgcagtacggcccgcacctcgcaatggtgcaggcgcagcgaggcgagcccaaatgtaccatcgccgcgatctacgccgtcttctgcctgatccacgatcccacccaccgtgtgctgatcgtatcggcaggcggcactcaggcatccgagattgctacgctgattcagcgcatcatctgtgtggtgccgacgttggagtgcatccgcaaatgtaagaacgcgggcgaccgcacctccgtggatgcgttcgacgtgcaccactcgctgaagggcatcgacaagtccccgagcgtggcgtgtatcggcgtcaccggcaacctgccgggtaagcgtgcgaaactgctgatcgcggacgacgtggagtccaacaagaatagccgtactgccgcgaaccgcgagctgctgctgaccatcacgttggagttctcggccatctgcaccggcaagcccggtactcccggccgcatcctgtacctagggacgccgcagaccggcgactccatctacaacaccctgcccggacgtggctacgacgttcgcatctggcccggtcgatacccgacccctgcacagcgcgagcactacggcccgcatctggcaccgtccatcgtacagcgcctcgaagccgacccgatgttggcgttcggtggtggcccgatgggcgacgagggccagtgcaccgacgagctgttggccggtgagcagaagcaccagtccgagctgcgtcagcgcggaccgtccagctaccagctgaactacatgctcaacacgcggctgatggatgcgctccgcttcccgctgaagaccgagaacctgatcgtgatccccggtggcggcgaccgcttcccgctgacgatcactcgtggcctgagcaacgcgcaccagcgcagcttccagtctagcgggtacggcttcgtcatgatgatgccgcacgacatgagcaccgagactgccccagtgcagggcgtgcacatgcagatcgacccggctggtggtggtgccaacggagacgagacggccttcgccgtgaccgccttcctcaactccaccgtgtacgtgttggccgtaggcgctgtgcccggtggctacgacggtgatggtctgctcgaactccgccgcatcgcggtgaagtacaagccgaatgtcatcagcatcgaaaagaacatgggctacggcgcgttcgccaaggtgttcctgcctgtcctgcgagaagatcgcggtaccgagaagggatacaagggcgacatccgcgaggagttcgtgaccggcaacaaggaagcccgcatcatcggcacgctcgaacctgtcatggctcgtggctcgctggtcatgctggaatccgtggttgaaatggatcacgagtacactcagcgctacgcatccagcggaaagcgtcaggtctacagcctgttccaccagatggcgaagatcacgcagcagaagggcagcatcgcacacgatgaccgcctcgatgcactggaaggaagcgtgcgccactgggttgcgcagcttgcactggaccagaacaaggccattgccaagcagcagcagcgagagttccaagactggatcaacgatccgaccggcatgaaggcagcgacccgcaagagtccactgcaacgtggccgtccatccctactcgaccgttaccggaggtaaccaatgcagaagtccgacttcaccagcaactacacgggcctgttcggccgtggcaactacctgcaccgcgaactgctcgccctcgtggagcatgcagagcagcatcccgcaaccgcagcgcagctgctcgcccagttccagaaggacgcgaccctcgtgctcgacgccctgatcgctgccggtgcgcgcacgcagtcctcgggtccgaactccggcccgcacactccggtcgatctggacccggacgatgacccgctgaccccgtaaggagcaaccatgaaccagcagcagaaccaagataccagcaacaaggggctgttcggcctgatcggcggcatcttcatcggcatttcggcaacgctgctgtcattcacccaaggccacgaaggggtacgctacgctgcgtacctcgacaccggccgggtgccgaccatctgctacggccacaccaagggcgtagcgatgggcatgacggcaacgaaggcacagtgcgacaagtggctgatcgaagacctacagatcgcccagaagggcgtgcgtaagcacctgaaggttcccgttaaccgcaaccagatcgacgcctacacggacttcgtgttcaacgtgggcgagaaggcgttcgctgatagcaccatgctgcgcaaggcgaacgcaggggatcgtgaaggtagctgcaaggagttcctgcgctgggtctacgtcggtaagctcgactgccgactgtccagcagccgctgctccggcattcccaagcgccgcgacgcagagtttgccctctgcctgcgccccaacaacgaggtgatccaaccgtggaaaccccaagtgaagtgatcgcacgactcggcggcaaggctatcggcctgctgctggtcgtgaccatgttcgtgtgcttcggtctgtacgtctacggcctgcaacgcaaggtggagaagctggaaactgcccaagtcggcacgaccgctaccgccaaggctgcgcagactcaggctaccgggtacgcaacctacatcaaagagaaggaggatgtgcgtgttcgcaccgaagaagctctcgacgccgttcccgagtatcgtgacggcactgttcctgctgatgtcgctgacctcctgcgcgaacctgccggttcccagcgatgatctactgaaggactgtcacatcacctacctcggtggtgagcgcggcacgtcttccagtcaggacaaggtggtcaagctcgcgcaggaccgccgcatggacaccgttctgtgcaacaaggacaaggccgcgctgcgtgcgtggaaggaagaagtgtgcggtaccggcaagcgccggtgtacgggggacaagtgaccaccatcgcgtgggacgggaagcacctgtgggcggacagtcaggccacacagggcgaccacaagcacaccgtccgcaaaatcctccctgtctcgacacccaccggccctgtgctgctgggtgtcaccggggatttcacagtgcttcgcccggttctcgctgcgcttaaagcgggcgaagggtacgaggagcacgttggcaagtccgccacggtccttgtggttaaggacggcgtactcacggtcactactggtaagcagcagtgggtcgaggaggctccgtacttcgatggaagcggcaaggcgctagctctaggggcctatcatgcgagcaagtctgtggctaaggccatggctgccgcgatagctcacgatgtgtatagctccgggcctatcatcaagctaaaggcaccagttcgcaaggcttagtcataaggccacgtggatagccggaccaaaatttgcttcggaaatgcgcgggggtcactccaatagaagctcccgcgcgtgcccccatacgcccgtgcgttacgcgcctgcgggtgcgcccgcctgcgtgctcgcgtgtgcgcctgtgtgcgcgtctgtgcgcccgcgtcaaggttccgcgtgggtgtgtgcctgtgcctgcctgcgcgtggcgtgtgggcgcgcgtgtggcgtgtgcgtgggtgcctgcgtgggcgggtgcgcggttccttcctcgggctggaccgtgccgccttggctgaatggttaataaatcttccgcgattggtgcttgacggcaggtcgggagtgtggtttcatagcgtcactggggcagcgacagggcctcaggagggccgcaaggggcttgacaggtgcatacctacctgctaccatgcgaaccgcagctgtaggcgtgtgagggccatctgtatcgtttcggccttttggtacacctatagcacacagtgccgtcgatcctgaacgccgagctatcggtactctgtcgaggcactaagtgagccacccgctaggccaacggttgacaccggccctgcaacgtggtaagctgattcggaagtcgagtgatgtaggccgtagtggcgctgccaacaagcgagctaagggtacatgggtgctactggaacgggatgcgaggagctaccgaaccacac

What is claimed is:

1. A method of preventing or reducing symptoms or disease associated with *Xylella fastidiosa* or *Xanthomonas* in a plant, comprising contacting said plant with particles of at least one virulent bacteriophage, wherein *Xylella fastidiosa* and/or *Xanthomonas axonopodis* are hosts of the bacteriophage, wherein the bacteriophage is a Xfas 300-type bacteriophage and displays the following characteristics:

(a) the bacteriophage is capable of lysing said *Xylella fastidiosa* and/or *Xanthomonas* bacteria;

(b) the bacteriophage infects a cell by binding to a Type IV pilus;

(c) the bacteriophage comprises a non-contractile tail with a capsid size ranging from 58-68 nm in diameter and belongs to the Podoviridae family;

(d) the genomic size of the bacteriophage is about 43300 bp to 44600 bp; and (e) the bacteriophage prevents or reduces symptoms associated with Pierce's disease in a plant or plants.

2. The method of claim 1, wherein contacting comprises introducing the bacteriophage particles into the plant.

3. The method of claim 1, wherein the plant is selected from the group consisting of a grapevine plant, a citrus plant, almond, coffee, alfalfa, oleander, oak, sweetgum, redbud, elm, peach, apricot, plum, blackberry, mulberry, and *Chitalpa tashkentensis*.

4. The method of claim 1, wherein the bacteriophages are introduced into the plant by injection, by an insect vector, via the root system, by spray, by mist, or by dust on the plant.

5. The method of claim 4, wherein the insect vector is a glassy winged sharpshooter.

6. The method of claim 4, wherein the number of said bacteriophage to be introduced into said plant is from 1 to $10^{12}$ PFU/ml.

7. The method of claim 4, wherein the number of said bacteriophage to be introduced into said plant is from $10^4$ to $10^{11}$ PFU/ml.

8. The method of claim 4, wherein the number of said bacteriophage to be introduced into said plant is from $10^7$ to $10^{10}$ PFU/ml.

9. The method of any one of claims 1 to 2, wherein said bacteriophage virulent to *Xylella fastidiosa* and *Xanthomonas* species are introduced simultaneously or sequentially to the plant by a combination of two, three, four, five, or six virulent bacteriophage strains.

10. The method of claim 1, defined as comprising contacting a population of plants with the bacteriophage particles to prevent or reduce symptoms associated with *X. fastidiosa* and subspecies thereof in the population.

11. The method of claim 1, wherein said virulent bacteriophage comprises at least one bacteriophage strain which is a member of the Xfas300 phage type; wherein the phage is selected from the group consisting of: Xfas302, Xfas303, Xfas304, and Xfas306; wherein representative samples of said phage have been deposited under ATCC Accession Numbers PTA-13098, PTA-13099, PTA-13100, and PTA-13097, respectively, for phages Xfas302, Xfas303, Xfas304, and Xfas306.

12. The method of claim 1, further comprising contacting said plant with particles of at least one virulent bacteriophage, wherein *Xylella fastidiosa* and/or *Xanthomonas axonopodis* are hosts of the bacteriophage, wherein the bacteriophage is a Xfas 100-type bacteriophage and displays the following characteristics:

(a) the bacteriophage is capable of lysing said *Xylella fastidiosa* and/or *Xanthomonas* bacteria;

(b) the bacteriophage infects a cell by binding to a Type IV pilus;

(c) the bacteriophage comprises a non-contractile tail with a capsid size ranging from 55-77 nm in diameter and belongs to the Siphoviridae family;

(d) the genomic size of the bacteriophage is about 55500 bp to 56200 bp; and (e) the bacteriophage prevents or reduces symptoms associated with Pierce's disease in a plant or plants.

13. The method of claim 12, wherein said virulent bacteriophage comprises at least one bacteriophage strain which is a member of the Xfas 100 phage type; wherein the phage is selected from the group consisting of: Xfas 103 and Xfas 106, and wherein representative samples of said phage have been deposited under ATCC Accession Numbers PTA-13096 and PTA-13095, respectively, for phages Xfas 103 and Xfas 106.

* * * * *